US010669554B2

(12) United States Patent
Walsh et al.

(10) Patent No.: US 10,669,554 B2
(45) Date of Patent: Jun. 2, 2020

(54) PRODUCTION OF DHA AND OTHER LC PUFAS IN PLANTS

(71) Applicants: Dow AgroSciences LLC, Indianapolis, IN (US); DSM IP ASSETS B.V., TE Heerlen (NL)

(72) Inventors: Terence A. Walsh, Zionsville, IN (US); Daniel Gachotte, Indianapolis, IN (US); Ann Owens Merlo, Carmel, IN (US); Paul Gordon Roessler, Ft. Myers, FL (US); James Metz, Longmont, CO (US); Scott Bevan, Indianapolis, IN (US); Jerry Kuner, Longmont, CO (US)

(73) Assignees: Dow AgroSciences LLC, Indianapolis, IN (US); DSM IP ASSETS B.V. (NL)

( * ) Notice: Subject to any disclaimer, the term of this patent is extended or adjusted under 35 U.S.C. 154(b) by 43 days.

(21) Appl. No.: 15/825,107

(22) Filed: Nov. 29, 2017

(65) Prior Publication Data

US 2018/0073036 A1    Mar. 15, 2018

Related U.S. Application Data

(63) Continuation of application No. 13/698,412, filed as application No. PCT/US2011/036869 on May 17, 2011, now abandoned.

(60) Provisional application No. 61/345,537, filed on May 17, 2010.

(51) Int. Cl.
*C12N 15/82* (2006.01)
*C12P 7/64* (2006.01)
*C12N 9/10* (2006.01)
*C12N 9/12* (2006.01)

(52) U.S. Cl.
CPC ........ *C12N 15/8247* (2013.01); *C12P 7/6427* (2013.01); *C12N 9/1029* (2013.01); *C12N 9/1288* (2013.01)

(58) Field of Classification Search
None
See application file for complete search history.

(56) References Cited

U.S. PATENT DOCUMENTS

| 2004/0049806 A1* | 3/2004 | Kunst | C12N 9/1029 800/281 |
| 2008/0022422 A1* | 1/2008 | Weaver | C12N 9/93 800/278 |

FOREIGN PATENT DOCUMENTS

| WO | WO-2000029596 | * | 5/2000 | |
| WO | WO-2007106905 A2 | * | 9/2007 | C12N 9/1029 |

OTHER PUBLICATIONS

Friedberg (Automated protein function prediction—the genomic challenge. Brief. Bioinformatics. 7:225-242, 2006) (Year: 2006).*
Wu et al (Stepwise engineering to produce high yields of very long-chain polyunsaturated fatty acids in plants. Nature Biotechnology, 23: 1013-1017, 2005) (Year: 2005).*

* cited by examiner

*Primary Examiner* — Medina A Ibrahim
*Assistant Examiner* — Wayne Zhong
(74) *Attorney, Agent, or Firm* — Magieby Cataxinos & Greenwood

(57) ABSTRACT

The invention provides recombinant host organisms (e.g., plants) genetically modified with a polyunsaturated fatty acid (PUFA) synthase system and one or more accessory proteins (e.g., PPTase and/or ACoAS) that allow for and/or improve the production of PUFAs in the host organism. The present invention also relates to methods of making and using such organisms (e.g., to obtain PUFAs) as well as products obtained from such organisms (e.g., oil and/or seed).

14 Claims, 52 Drawing Sheets

Specification includes a Sequence Listing.

FIG. 1

Lane 1 Molecular Weight Marker
Lane 2 *Schizochytrium* extract positive control
Lane 3, 15 days after pollination (DAP)
Lane 4 20 DAP
Lane 5 25 DAP
Lane 6 30 DAP
Lane 7 35 DAP
Lane 8 42 DAP
Lane 9 15 DAP Null
Lane 10 20 DAP Null
Lane 11 5197-[14]-032.Sx002.Sx050.020 Mature
Lane 12 5197-[14]-032.Sx002.Sx050.012 Mature
Lane 13 5197-[14]-032.Sx002.Sx050.011 Mature
Lane 14 5197-[14]-032.Sx002.Sx050.017 Mature
Lane 15 5197-[14]-032.Sx002.Sx050.016 Mature

PRODUCTION OF DHA AND OTHER LC PUFAS IN PLANTS

BACKGROUND OF THE INVENTION

Field of the Invention

The present invention generally relates to recombinant host organisms (e.g., plants) genetically modified with a polyunsaturated fatty acid (PUFA) synthase system and one or more accessory proteins that allow for and/or improve the production of PUFAs in the host organism. The present invention also relates to methods of making and using such organisms (e.g., to obtain PUFAs) as well as products obtained from such organisms (e.g., oil and seed).

Background Art

Polyunsaturated fatty acids (PUFAs) are considered to be useful for nutritional applications, pharmaceutical applications, industrial applications, and other purposes. However, the current supply of PUFAs from natural sources (e.g., fish oils) and from chemical synthesis is not sufficient for long-term commercial needs.

Vegetable oils derived from plants (e.g., oil seed crops) are relatively inexpensive and do not have the contamination issues associated with fish oils. However, the PUFAs found in commercially-developed plants and plant oils do not typically include more saturated or longer-chain PUFAs, and only typically include fatty acids such as linoleic acid (eighteen carbons with 2 double bonds, in the delta 9 and 12 positions—18:2 delta 9,12) and linolenic acid (18:3 delta 9,12,15).

The production of more unsaturated or longer-chain PUFAs in plants by the modification of the fatty acids endogenously produced by plants has been described. For example, the genetic modification of plants with various individual genes encoding fatty acid elongases and/or desaturases has been described as resulting in the generation of leaves or seeds containing significant levels of longer-chain and more unsaturated PUFAs such as eicosapentaenoic acid (EPA), but also containing significant levels of mixed shorter-chain and less unsaturated PUFAs (Qi et al., *Nature Biotech.* 22:739 (2004); WO 04/071467; Abbadi et al., *Plant Cell* 16:1 (2004); Napier and Sayanova, *Proceedings of the Nutrition Society* 64:387-393 (2005); Robert et al., *Functional Plant Biology* 2:473-479 (2005); U.S. Appl. Pub. No. 2004/0172682).

The genus *Brassica* includes canola, one of the world's most important oilseed crops, and the most important oilseed crop grown in temperate geographies. Canola has been traditionally characterized as *Brassica napus* (a species derived as a result of inter-specific crosses of *Brassica rapa* and *Brassica oleracea*) in which erucic acid and glucosinolates have been eliminated or significantly reduced through conventional breeding. The majority of canola oil is in the form of vegetable oils produced for human consumption. There is also a growing market for the use of canola oil in industrial applications.

The quality of edible and industrial oil derived from a particular variety of canola seed is determined by its constituent fatty acids, as the type and amount of fatty acid unsaturation have implications for both dietary and industrial applications. Conventional canola oil contains about 60% oleic acid (C18:1), about 20% linoleic acid (C18:2) and about 10% linolenic acid (18:3). The levels of polyunsaturated linolenic acid typical of conventional canola are undesirable as the oil is easily oxidized, the rate of oxidation being affected by several factors, including the presence of oxygen, exposure to light and heat, and the presence of native or added antioxidants and pro-oxidants in the oil. Oxidation causes off-flavors and rancidity of as a result of repeated frying (induced oxidation) or storage for a prolonged period (auto-oxidation). Oxidation can also alter the lubricative and viscous properties of canola oil.

Oils exhibiting reduced levels of polyunsaturated fatty acids and increases in the level of monounsaturated oleic acid relative to conventional canola oil are associated with higher oxidative stability. The susceptibility of individual fatty acids to oxidation is dependent on their degree of unsaturation. Thus, the rate of oxidation of linolenic acid, which possesses three carbon-carbon double bonds, is 25 times that of oleic acid, which has only one double bond, and 2 times that of linoleic acid, which has two double bonds. Linoleic and linolenic acids also have the most impact on flavor and odor because they readily form hydroperoxides. High oleic oil (≥70% oleic acid) is less susceptible to oxidation during storage, frying and refining, and can be heated to a higher temperature without smoking, making it more suitable as cooking oil. Examples of commercially sold canola varieties having a fatty acid profile in seed oil of oleic acid (C18:1) above 70% (by weight) and linolenic acid (C18:3) below 3.5% (by weight) produce a non-hydrogenated, high oleic acid, low linolenic acid oils currently used in numerous applications, including deep frying, sautéing, baking, spraying and in salad dressings, by restaurants and the foodservice industry.

BRIEF SUMMARY OF THE INVENTION

There is a need in the art for a relatively inexpensive method to efficiently and effectively produce quantities (e.g., commercial quantities) of longer-chain or more unsaturated PUFAs in plants, plant seed or plant oil, as well as quantities of lipids (e.g., triacylglycerol (TAG) and phospholipid (PL)) enriched in such PUFAs in plants, plant seed or plant oil. A system for providing and improving PUFA production in host organisms (e.g., plants) by providing recombinant host organisms genetically modified with a polyunsaturated fatty acid (PUFA) synthase and one or more accessory proteins, as described herein, is a significant alternative to the approaches in the art.

The present invention is directed to genetically modified plants (e.g., *Brassica*), descendants, seeds, cells, tissues, or parts thereof, comprising (i) a nucleic acid sequence encoding a polyunsaturated fatty acid (PUFA) synthase system (e.g., an algal PUFA synthase system) that produces at least one PUFA; and (ii) a nucleic acid sequence encoding a phosphopantetheinyl transferase (PPTase) that transfers a phosphopantetheinyl cofactor to an PUFA synthase system (e.g., an algal PUFA synthase system) ACP domain. In some embodiments, the genetically modified plant, descendant, seed, cell, tissue, or part thereof is from an economically important *Brassica* species (e.g., *Brassica napus* or *Brassica juncea*). In some embodiments, the PUFA synthase system comprises an amino acid sequence that is at least 60% to 99% identical to the amino acid sequence of SEQ ID NO:1 or comprises the amino acid sequence of SEQ ID NO:1. In some embodiments, the nucleic acid sequence encoding the PUFA synthase system comprises a nucleic acid sequence at least 60% to 99% identical to the nucleic acid sequence of SEQ ID NO:6 or comprises the nucleic acid sequence of SEQ ID NO:6. In some embodiments, the PUFA synthase system comprises an amino acid sequence that is at least 60% to 99% identical to the amino acid sequence of SEQ ID NO:2 or comprises the amino acid sequence of SEQ ID NO:2. In some embodiments, the nucleic acid sequence encoding the PUFA synthase system comprises a nucleic acid sequence that is at least 60% to 99% identical to the nucleic acid sequence of SEQ ID NO:7 or comprises the nucleic acid sequence of SEQ ID NO:7. In some embodiments, the PUFA synthase system comprises an amino acid sequence that is at least 60% to 99% identical to the amino acid sequence of SEQ ID NO:3 or comprises the amino acid sequence of SEQ ID NO:3. In some embodiments, the nucleic acid sequence encoding the PUFA synthase system comprises a nucleic acid sequence that is at least 60% to 99% identical to the nucleic acid sequence of SEQ ID NO:8 or comprises the nucleic acid sequence of SEQ ID NO:8. In some embodiments, the PUFA synthase system comprises the amino acid sequence of SEQ ID NOs: 1, 2, or 3 or any combination thereof. In some embodiments, the nucleic acid sequence encoding the PUFA synthase system comprises the nucleic acid sequence of SEQ ID NOs: 6, 7 or 8 of any combination thereof.

In some embodiments, the PPTase comprises an amino acid sequence that is at least 60% to 99% identical to SEQ ID NO:5 or comprises the amino acid sequence of SEQ ID NO:5. In some embodiments, the nucleic acid sequence encoding the PPTase is at least 60% to 99% identical to the nucleic acid sequence of SEQ ID NO:10 or comprises the nucleic acid sequence of SEQ ID NO:10.

In some embodiments, the nucleic acid sequences of (i) and (ii) are contained in a single recombinant expression vector. In some embodiments, the nucleic acid sequences of (i) and (ii) are operably linked to a seed-specific promoter. In some embodiments, the nucleic acid sequences of (i) and (ii) are operably linked to a promoter selected from the group consisting of PvDlec2, PvPhaseolin, LfKCS3 and FAE 1.

In some embodiments, the genetically modified plant (e.g., a *Brassica* species producing canola oil), descendant, seed, cell, tissue, or part thereof further comprises (iii) a nucleic acid sequence encoding an acyl-CoA synthetase (ACoAS) that catalyzes the conversion of long chain PUFA free fatty acids (PFFA) to acyl-CoA. In some embodiments, the ACoAS comprises an amino acid sequence that is at least 60% to 99% identical to SEQ ID NO:4 or comprises the amino acid sequence of SEQ ID NO:4, in some embodiments, the ACoAS comprises a nucleic acid sequence that is at least 60% to 99% identical to the nucleic acid sequence of SEQ ID NO:9 or comprises the nucleic acid sequence of SEQ ID NO:9. In some embodiments, the nucleic acid sequence encoding the ACoAS comprises the nucleic acid sequence of SEQ ID NO:34. In some embodiments, the nucleic acid sequences of (i), (ii) and/or (iii) are contained in a single recombinant expression vector. In some embodiments, the nucleic acid sequences of (i), (ii) and/or (iii) are operably linked to a seed-specific promoter. In some embodiments, the nucleic acid sequences of (i), (ii) and/or (iii) are operably linked to a promoter selected from the group consisting of: PvDlec2, LfKCS3 and FAE 1.

In some embodiments, the genetically modified plant *Brassica*), descendant, cell, tissue, or part thereof further comprises a nucleic acid sequence encoding an acetyl CoA carboxylase (ACCase) and/or a nucleic acid sequence encoding a type 2 diacylglycerol acyltransferase (DGAT2).

The present invention is directed to an isolated nucleic acid molecule comprising a nucleic acid sequence selected from SEQ ID NOs: 6-10 and SEQ ID NO:34, a recombinant expression vector pDAB7361, a recombinant expression vector pDAB7362, a recombinant expression vector pDAB7363, a recombinant expression vector pDAB7365, a recombinant expression vector pDAB7368, a recombinant expression vector pDAB7369, a recombinant expression vector pDAB7370, a recombinant expression vector pDAB100518, a recombinant expression vector pDAB101476, recombinant expression vector pDAB9166, a recombinant expression vector pDAB9167, a recombinant expression vector pDAB7379, a recombinant expression vector pDAB7380, a recombinant expression vector pDAB9323, a recombinant expression vector pDAB9330, a recombinant expression vector pDAB9337, a recombinant expression vector pDAB9338, a recombinant expression vector pDAB9344, a recombinant expression vector pDAB9396, a recombinant expression vector pDAB101412, a recombinant expression vector pDAB7733, a recombinant expression vector pDAB7734, a recombinant expression vector pDAB101493, a recombinant expression vector pDAB109507, a recombinant expression vector pDAB109508, a recombinant expression vector pDAB109509, a recombinant expression vector pDAB9151, a recombinant expression vector pDAB108207, a recombinant expression vector pDAB108208, a recombinant expression vector pDAB108209, a recombinant expression vector pDAB9159, a recombinant expression vector pDAB9147, a recombinant expression vector pDAB108224, or a recombinant expression vector pDAB108225.

In some embodiments, a seed oil obtained from the genetically modified plant, descendant, seed, cell, tissue, or part thereof comprises detectable amounts of DHA (docosahexaenoic acid (C22:6, n-3)) and/or EPA (eicosapentaenoic acid (C20:5, n-3)). In some embodiments, the seed oil comprises 0.01% to 15% DHA, 0.05% to 10% DHA, or 0.05% to 5% DHA. In some embodiments, the seed oil comprises 0.01% to 5% EPA, 0.05% to 5% EPA, or 0.05% to 1% EPA. In other embodiments, the detectable amounts of DHA and/or EPA found in the seed oil are also found in grain and/or meal obtained from the genetically modified plant. In some embodiments, the detectable amounts of DHA and/or EPA are found seed oil of a *Brassica* species having a fatty acid content comprising, by weight, 70% or greater of oleic acid (C18:1) and/or 4% or lower linolenic acid (C18:3).

The present invention is directed to an oil or a seed obtained from a genetically modified plant (e.g., *Brassica*), descendant, cell, tissue, or part thereof described herein. The present invention is directed to a food product comprising an oil obtained from a genetically modified plant, descendant, cell, tissue, or part thereof described herein. The present invention is also directed to a functional food comprising an oil obtained from a genetically modified plant, descendant, cell, tissue, or part thereof described herein, or a seed obtained from a genetically modified plant, descendant, cell, tissue, or part thereof described herein. The present invention is directed to a pharmaceutical product comprising an oil obtained from a genetically modified plant, descendant, cell, tissue, or part described herein.

The present invention is directed to a method to produce an oil comprising at least one LC-PUFA, comprising recovering oil from a genetically modified plant (e.g., *Brassica*), descendant, cell, tissue, or part thereof described herein or from a seed of a genetically modified plant (e.g., *Brassica*), descendant, cell, tissue, or part thereof described herein. The present invention is also directed to a method to produce an oil comprising at least one LC-PUFA, comprising growing a genetically modified plants (e.g., *Brassica*), descendant, cell, tissue, or part thereof described herein. The present invention is also directed to a method to produce at least one LC-PUFA in a seed oil, comprising recovering oil from a seed of a genetically modified plant (e.g., *Brassica*), descendant, cell, tissue, or part thereof described herein.

The present invention is directed to a method to produce at least one PUFA in a seed oil, comprising growing a genetically modified plant (e.g., *Brassica*), descendant, cell, tissue, or part thereof described herein. The present invention is also directed to a method to provide a supplement or therapeutic product containing at least one PUFA to an individual, comprising providing to the individual a genetically modified plant (e.g., *Brassica*), descendant, cell, tissue, or part thereof of described herein, an oil described herein, a seed described herein, a food product described herein, a functional food described herein, or a pharmaceutical product described herein. In some embodiments, a PUFA contained in such embodiments is DHA and/or EPA.

The present invention is directed to a method to produce a genetically modified plant (e.g., *Brassica*), descendant, cell, tissue, or part thereof described herein, comprising transforming a plant or plant cell with (i) a nucleic acid sequence encoding a PUFA synthase system (e.g., an algal PUFA synthase system) that produces at least one polyunsaturated fatty acid (PUFA); and (ii) a nucleic acid sequence encoding a phosphopantetheinyl transferase (PPTase) that transfers a phosphopantetheinyl cofactor to an PUFA synthase system (e.g., an algal PUFA synthase system) ACP domain. In some embodiments, the method further comprises transforming the plant or plant cell with (iii) a nucleic acid sequence encoding an acyl-CoA synthetase (ACoAS) that catalyzes the conversion of long chain PUFA free fatty acids (FFA) to acyl-CoA.

BRIEF DESCRIPTION OF DRAWINGS

The various embodiments of the invention can be more fully understood from the following detailed description, the figures, and the accompanying sequence descriptions, which form a part of this application.

FIG. 1 depicts the Clustal W (alignments in Vector NTI) of the redesigned DNA sequences encoding each of the 9 repeat domains of PUFA OrfA.

DETAILED DESCRIPTION OF THE INVENTION

Figure 2:
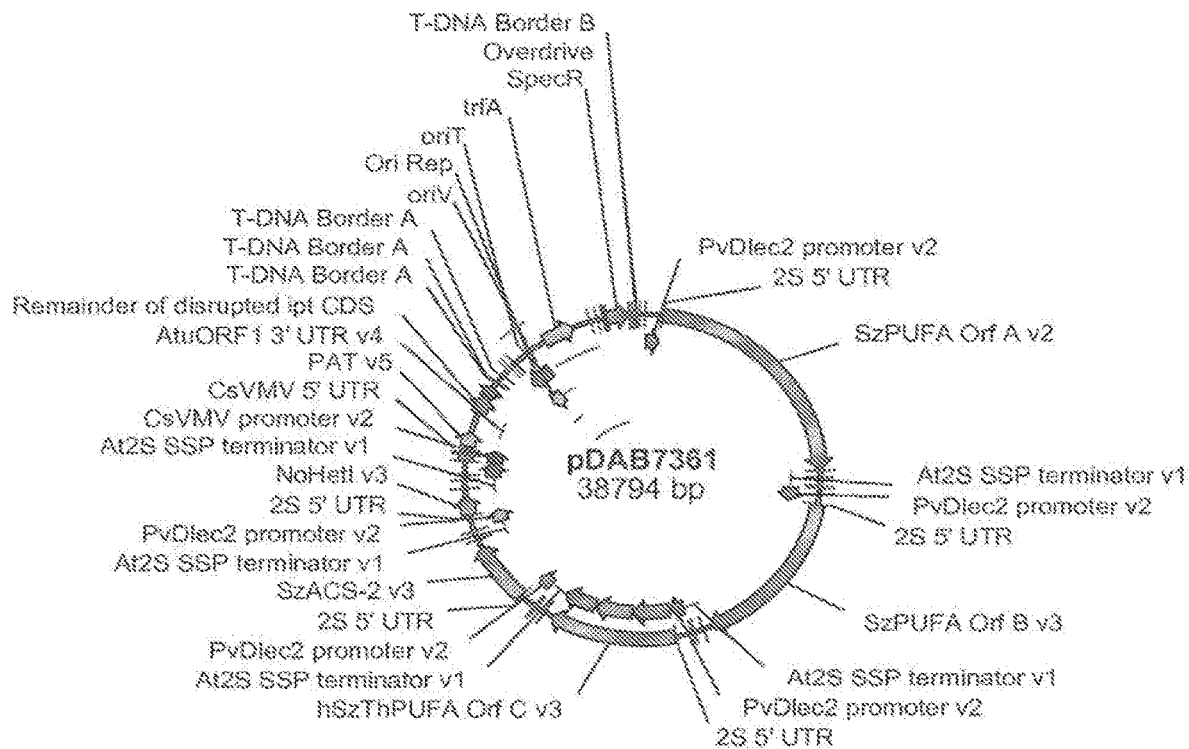
FIG. 2 shows the plasmid map of pDAB7361.

The term "polyunsaturated fatty acid" or "PUFA" as used herein refers to fatty acids with a carbon chain length of at least 16 carbons, at least 18 carbons, at least 20 carbons, or 22 or more carbons, with at least 3 or more double bonds, 4 or more double bonds, 5 or more double bonds, or 6 or more double bonds, wherein all double bonds are in the cis configuration.

The term "long chain polyunsaturated fatty acids" or "LC-PUFAs" as used herein refers to fatty acids of 18 and more carbon chain length, 20 and more carbon chain length, containing 3 or more double bonds, or 22 or more carbons, with at least 3 or more double bonds, 4 or more double bonds, 5 or more double bonds, or 6 or more double bonds. LC-PUFAs of the omega-6 series include, but are not limited to, gamma-linolenic acid (C18:3), di-homo-gamma-linolenic acid (C20:3n-6), arachidonic acid (C20:4n-6), adrenic acid (also called docosatetraenoic acid or DTA) (C22:4n-6), and docosapentaenoic acid (C22:5n-6). LC-PUFAs of the omega-3 series include, but are not limited to, alpha-linolenic acid (C18:3), eicosatrienoic acid (C20:3n-3), eicosatetraenoic acid (C20:4n-3), eicosapentaenoic acid (C20:5n-3), docosapentaenoic acid (C22:5n-3), and docosahexaenoic acid (C22:6n-3). LC-PUFAs also include fatty acids with greater than 22 carbons and 4 or more double bonds including but not limited to, C28:8(n-3).

The terms "PUFA synthase" or "PUFA synthase system" or "SzPUFA" or "hSzThPUFA" as used herein refers to an enzyme system that produces polyunsaturated fatty acids (PUFAs) and particularly, long chain PUFAs (LC-PUFAs) as well as any domain of such an enzyme in a complex. The term PUFA synthase includes, but is not limited to, PUFA PKS systems or PKS-like systems for the production of PUFAs.

The term "phosphopantetheinyl transferase" or "PPTase" or "NoHetI" as used herein refers to an enzyme which activates a PUFA synthase system by transferring a cofactor (e.g., 4-phosphopantetheine) from coenzyme A (CoA) to one or more ACP domain present in the PUFA synthase system.

The term "acyl-CoA synthetase" or "ACoAS" or "SzACS-2" as used herein refers to an enzyme that catalyzes the conversion of long chain polyunsaturated free fatty acids (FFA) to acyl-CoA.

The term "plant" as used herein includes, but is not limited to, any descendant, cell, tissue, or part of a plant.

"Nutraceutical" means a product isolated, purified, concentrated, or produced from plants that provides a physiological benefit or provides protection against disease, including processed foods supplemented with such products, along with foods produced from crops that have been genetically engineered to contain enhanced levels of such physiologically-active components.

"Functional food" means a food that (a) is similar in appearance to or can be a conventional food that is consumed as part of a usual diet and (b) has enhanced nutritional value and/or specific dietary benefits based on a modification in the proportion of components that typically exist in the unmodified food.

The terms "polynucleotide" and "nucleic acid" are intended to encompass a singular nucleic acid as well as plural nucleic acids, a nucleic acid molecule or fragment, variant, or derivative thereof, or construct, e.g., messenger RNA (mRNA) or plasmid DNA (pDNA). A polynucleotide or nucleic acid can contain the nucleotide sequence of the full-length cDNA sequence, or a fragment thereof, including the untranslated 5' and 3' sequences and the coding sequences. A polynucleotide or nucleic acid can be composed of any polyribonucleotide or polydeoxyribonucleotide, which can be unmodified RNA or DNA or modified RNA or DNA. For example, a polynucleotide or nucleic acid can be composed of single- and double-stranded DNA, DNA that is a mixture of single- and double-stranded regions, single- and double-stranded RNA, and RNA that is mixture of single- and double-stranded regions, hybrid molecules comprising DNA and RNA that can be single-stranded or, more typically, double-stranded or a mixture of single- and double-stranded regions. These terms also embraces chemically, enzymatically, or metabolically modified forms of a polynucleotide or nucleic acid.

A polynucleotide or nucleic acid sequence can be referred to as "isolated," in which it has been removed from its native environment. For example, a heterologous polynucleotide or nucleic acid encoding a polypeptide or polypeptide fragment having dihydroxy-acid dehydratase activity contained in a vector is considered isolated for the purposes of the present invention. Further examples of an isolated polynucleotide or nucleic acid include recombinant polynucleotides maintained in heterologous host cells or a purified (partially or substantially) polynucleotide or nucleic acid in solution. An isolated polynucleotide or nucleic acid according to the present invention further includes such molecules produced synthetically. An isolated polynucleotide or nucleic acid in the form of a polymer of DNA can be comprised of one or more segments of cDNA, genomic DNA or synthetic DNA.

The term "gene" refers to a nucleic acid or fragment thereof that is capable of being expressed as a specific protein, optionally including regulatory sequences preceding (5' non-coding sequences) and following (3' non-coding sequences) the coding sequence.

As used herein, the term "coding region" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences can include promoters, translation leader sequences, introns, polyadenylation recognition sequences, RNA processing site, effector binding site, and stem-loop structure.

As used herein, the terms "polypeptide" is intended to encompass a singular "polypeptide" as well as plural "polypeptides" and fragments thereof, and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, protein, amino acid chain, or any other term used to refer to a chain or chains of two or more amino acids, are included within the definition of "polypeptide," and the term "polypeptide" can be used instead of, or interchangeably with any of these terms. A polypeptide can be derived from a natural biological source or produced by recombinant technology, but is not necessarily translated from a designated nucleic acid sequence. It can be generated in any manner, including by chemical synthesis.

By an "isolated" polypeptide or a fragment, variant, or derivative thereof is intended a polypeptide that is not in its natural milieu. No particular level of purification is required. For example, an isolated polypeptide can be removed from its native or natural environment. Recombinantly produced polypeptides and proteins expressed in host cells are considered isolated for purposed of the invention, as are native or recombinant polypeptides which have been separated, fractionated, or partially or substantially purified by any suitable technique.

As used herein, "native" refers to the form of a polynucleotide, gene or polypeptide as found in nature with its own regulatory sequences, if present.

As used herein, "endogenous" refers to the native form of a polynucleotide, gene or polypeptide in its natural location in the organism or in the genome of an organism. "Endogenous polynucleotide" includes a native polynucleotide in its natural location in the genome of an organism. "Endogenous gene" includes a native gene in its natural location in the genome of an organism. "Endogenous polypeptide" includes a native polypeptide in its natural location in the organism.

As used herein, "heterologous" refers to a polynucleotide, gene or polypeptide not normally found in the host organism but that is introduced into the host organism. "Heterologous polynucleotide" includes a native coding region, or portion thereof, that is reintroduced into the source organism in a form that is different from the corresponding native polynucleotide. "Heterologous gene" includes a native coding region, or portion thereof, that is reintroduced into the source organism in a form that is different from the corresponding native gene. For example, a heterologous gene can include a native coding region that is a portion of a chimeric gene including non-native regulatory regions that is reintroduced into the native host. "Heterologous polypeptide" includes a native polypeptide that is reintroduced into the source organism in a form that is different from the corresponding native polypeptide.

As used herein, the term "modification" refers to a change in a polynucleotide disclosed herein that results in reduced, substantially eliminated or eliminated activity of a polypeptide encoded by the polynucleotide, as well as a change in a polypeptide disclosed herein that results in reduced, substantially eliminated or eliminated activity of the polypeptide. Such changes can be made by methods well known in the art, including, but not limited to, deleting, mutating (e.g., spontaneous mutagenesis, random mutagenesis, mutagenesis caused by mutator genes, or transposon mutagenesis), substituting, inserting, down-regulating, altering the cellular location, altering the state of the polynucleotide or polypeptide (e.g., methylation, phosphorylation or ubiquitination), removing a cofactor, introduction of an antisense RNA/DNA, introduction of an interfering RNA/DNA, chemical modification, covalent modification, irradiation with UV or X-rays, homologous recombination, mitotic recombination, promoter replacement methods, and/or combinations thereof. Guidance in determining which nucleotides or amino acid residues can be modified, can be found by comparing the sequence of the particular polynucleotide or polypeptide with that of homologous polynucleotides or polypeptides, e.g., yeast or bacterial, and maximizing the number of modifications made in regions of high homology (conserved regions) or consensus sequences.

The term "derivative," as used herein, refers to a modification of a sequence disclosed in the present invention. Illustrative of such modifications would be the substitution, insertion, and/or deletion of one or more bases relating to a nucleic acid sequence of a coding sequence disclosed herein that preserve, slightly alter, or increase the function of a coding sequence disclosed herein in oil seed crop species. Such derivatives can be readily determined by one skilled in the art, for example, using computer modeling techniques for predicting and optimizing sequence structure. The term "derivative" thus also includes nucleic acid sequences having substantial sequence homology with the disclosed coding sequences herein such that they are able to have the disclosed functionalities for use in producing LC-PUFAs of the present invention.

As used herein, the term "variant" refers to a polypeptide differing from a specifically recited polypeptide of the invention by amino acid insertions, deletions, mutations, and substitutions, created using, e.g., recombinant DNA techniques, such as mutagenesis. Guidance in determining which amino acid residues can be replaced, added, or deleted without abolishing activities of interest, can be found by comparing the sequence of the particular polypeptide with that of homologous polypeptides and minimizing the number of amino acid sequence changes made in regions of high homology (conserved regions) or by replacing amino acids with consensus sequences.

Alternatively, recombinant polynucleotide variants encoding these same or similar polypeptides can be synthesized or selected by making use of the "redundancy" in the genetic code. Various codon substitutions, such as silent changes which produce various restriction sites, can be introduced to optimize cloning into a plasmid or viral vector for expression. Mutations in the polynucleotide sequence can be reflected in the polypeptide or domains of other peptides added to the polypeptide to modify the properties of any part of the polypeptide.

Amino acid "substitutions" can be the result of replacing one amino acid with another amino acid having similar structural and/or chemical properties, conservative amino acid replacements, or they can be the result of replacing one amino acid with an amino acid having different structural and/or chemical properties, i.e., non-conservative amino acid replacements. "Conservative" amino acid substitutions can be made on the basis of similarity in polarity, charge, solubility, hydrophobicity, hydrophilicity, or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. Alternatively, "non-conservative" amino acid substitutions can be made by selecting the differences in polarity, charge, solubility, hydrophobicity, hydrophilicity, or the amphipathic nature of any of these amino acids. "Insertions" or "deletions" can be within the range of variation as structurally or functionally tolerated by the recombinant proteins. The variation allowed can be experimentally determined by systematically making insertions, deletions, or substitutions of amino acids in a polypeptide molecule using recombinant DNA techniques and assaying the resulting recombinant variants for activity.

The term "promoter" refers to a DNA sequence capable of controlling the expression of a coding sequence or functional RNA. In general, a coding sequence is located 3' to a promoter sequence. Promoters can be derived in their entirety from a native gene, or be composed of different elements derived from different promoters found in nature, or even comprise synthetic DNA segments. It is understood by those skilled in the art that different promoters can direct the expression of a gene in different tissues or cell types, or at different stages of development, or in response to different environmental or physiological conditions. Promoters which cause a gene to be expressed in most cell types at most times are commonly referred to as "constitutive promoters." It is further recognized that since in most cases the exact boundaries of regulatory sequences have not been completely defined, DNA fragments of different lengths can have identical promoter activity.

The term "operably linked" refers to the association of nucleic acid sequences on a single nucleic acid fragment so that the function of one is affected by the other. For example, a promoter is operably linked with a coding sequence when it is capable of effecting the expression of that coding sequence (e.g., that the coding sequence is under the transcriptional control of the promoter). Coding sequences can be operably linked to regulatory sequences in sense or antisense orientation.

The term "expression," as used herein, refers to the transcription and stable accumulation of sense (mRNA) or antisense RNA derived from the nucleic acid fragment of the invention. Expression can also refer to translation of mRNA into a polypeptide.

The term "overexpression" as used herein, refers to expression that is higher than endogenous expression of the same or related gene. A heterologous gene is overexpressed if its expression is higher than that of a comparable endogenous gene.

As used herein, the term "transformation" refers to the transfer of a nucleic acid or fragment into a host organism, resulting in genetically stable inheritance. Host organisms containing the transformed nucleic acid fragments are referred to as "transgenic" or "recombinant" or "transformed" organisms.

The terms "plasmid" and "vector" as used herein refer to an extra chromosomal element often carrying genes which are not part of the central metabolism of the cell, and usually in the form of circular double-stranded DNA molecules. Such elements can be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

As used herein, the term "codon degeneracy" refers to the nature in the genetic code permitting variation of the nucleotide sequence without affecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts refers to the alteration of codons in the gene or coding regions of the nucleic acid molecules to reflect the typical codon usage of the host organism without altering the polypeptide encoded by the DNA. Such optimization includes replacing at least one, or more than one, or a significant number, of codons with one or more codons that are more frequently used in the genes of that organism.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table 1. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 1

The Standard Genetic Code

|   | T | C | A | G |
|---|---|---|---|---|
| T | TTT Phe (F) | TCT Ser (S) | TAT Tyr (Y) | TGT Cys (C) |
|   | TTC Phe (F) | TCC Ser (S) | TAC Tyr (Y) | TGC |
|   | TTA Leu (L) | TCA Ser (S) | TAA Stop | TGA Stop |
|   | TTG Leu (L) | TCG Ser (S) | TAG Stop | TGG Trp (W) |
| C | CTT Leu (L) | CCT Pro (P) | CAT His (H) | CGT Arg (R) |
|   | CTC Leu (L) | CCC Pro (P) | CAC His (H) | CGC Arg (R) |
|   | CTA Leu (L) | CCA Pro (P) | CAA Gln (Q) | CGA Arg (R) |
|   | CTG Leu (L) | CCG Pro (P) | CAG Gln (Q) | CGG Arg (R) |
| A | ATT Ile (I) | ACT Thr (T) | AAT Asn (N) | AGT Ser (S) |
|   | ATC Ile (I) | ACC Thr (T) | AAC Asn (N) | AGC Ser (S) |
|   | ATA Ile (I) | ACA Thr (T) | AAA Lys (K) | AGA Arg (R) |
|   | ATG Met (M) | ACG Thr (T) | AAG Lys (K) | AGG Arg (R) |
| G | GTT Val (V) | GCT Ala (A) | GAT Asp (D) | GGT Gly (G) |
|   | GTC Val (V) | GCC Ala (A) | GAC Asp (D) | GGC Gly (G) |
|   | GTA Val (V) | GCA Ala (A) | GAA Glu (E) | GGA Gly (G) |
|   | GTG Val (V) | GCG Ala (A) | GAG Glu (E) | GGG Gly (G) |

Many organisms display a bias for use of particular codons to code for insertion of a particular amino acid in a growing peptide chain. Codon preference, or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

Given the large number of gene sequences available for a wide variety of animal, plant and microbial species, it is possible to calculate the relative frequencies of codon usage. Codon usage tables are readily available and can be adapted in a number of ways. See Nakamura et al. *Nucl. Acids Res.* 28:292 (2000). By utilizing this or similar tables, one of ordinary skill in the art can apply the frequencies to any given polypeptide sequence, and produce a nucleic acid fragment of a codon-optimized coding region which encodes the polypeptide, but which uses codons optimal for a given species. The present invention pertains to codon optimized forms of OrfA, OrfB, chimeric OrfC, PPTase and/or other accessory proteins of the invention, as described further herein.

The term "percent identity," as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case can be, as determined by the match between strings of such sequences. "Identity"

and "similarity" can be readily calculated by known methods, including but not limited to those disclosed in: 1) *Computational Molecular Biology* (Lesk, A. M., Ed.) Oxford University: NY (1988); 2) *Biocomputing: Informatics and Genome Projects* (Smith, D. W., Ed.) Academic: NY (1993); 3) *Computer Analysis of Sequence Data, Part I* (Griffin, A. M., and Griffin, H. G., Eds.) Humania: NJ (1994); 4) *Sequence Analysis in Molecular Biology* (von Heinje, G., Ed.) Academic (1987); and 5) *Sequence Analysis Primer* (Gribskov, M. and Devereux, J., Eds.) Stockton: NY (1991).

Methods to determine identity are designed to give the best match between the sequences tested. Methods to determine identity and similarity are codified in publicly available computer programs. Sequence alignments and percent identity calculations can be performed, for example, using the AlignX program of the Vector NTI® suite (Invitrogen, Carlsbad, Calif.) or MegAlign™ program of the LASERGENE bioinformatics computing suite (DNASTAR Inc., Madison, Wis.). Multiple alignment of the sequences is performed using the "Clustal method of alignment" which encompasses several varieties of the algorithm including the "Clustal V method of alignment" corresponding to the alignment method labeled Clustal V (disclosed by Higgins and Sharp, *CABIOS.* 5:151-153 (1989); Higgins, D. G. et al., *Comput. Appl. Biosci.,* 8:189-191 (1992)) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins and Sharp, *CABIOS.* 5:151-153 (1989); Higgins, D. G. et al., *Comput. Appl. Biosci.* 8:189-191 (1992)) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, from other species, wherein such polypeptides have the same or similar function or activity. Useful examples of percent identities include, but are not limited to: 60%, 65%, 70%, 75%, 80%, 85%, 90%, or 95%, or any integer percentage from 60% to 100% can be useful in describing the present invention, such as 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable nucleic acid fragments not only have the above homologies but typically encode a polypeptide having at least 50 amino acids, at least 100 amino acids, at least 150 amino acids, at least 200 amino acids, and at least 250 amino acids.

The term "sequence analysis software" refers to any computer algorithm or software program that is useful for the analysis of nucleotide or amino acid sequences. "Sequence analysis software" can be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J Mol. Biol.,* 215:403-410 (1990)); 3.) DNASTAR (DNASTAR, Inc. Madison, Wis.); 4.) Sequencher (Gene Codes Corporation, Ann Arbor, Mich.); and 5.) the FASTA program incorporating the Smith-Waterman algorithm (W. R. Pearson, *Comput. Methods Genome Res.,* [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used here are well known in the art and are described, e.g., by Sambrook et al., *Molecular Cloning: A Laboratory Manual,* Third Edition, Cold Spring Harbor Laboratory Press, Cold Spring Harbor, N.Y. (2000); and by Silhavy et al., *Experiments with Gene Fusions,* Cold Spring Harbor Laboratory Press, Cold Spring Harbor, N.Y. (1984); and by Ausubel et al., *Current Protocols in Molecular Biology,* published by Greene Publishing Assoc. and Wiley-Interscience (1987 to present).

The genetic manipulations of a recombinant hosts disclosed herein can be performed using standard genetic techniques and screening and can be made in any host cell that is suitable to genetic manipulation. In some embodiments, a recombinant host cell disclosed herein can be any organism or microorganism host useful for genetic modification and recombinant gene expression. In some embodiments, a recombinant host can be but is not limited to any higher plant, including both dicotyledonous and monocotyledonous plants, and consumable plants, including crop plants and plants used for their oils. Thus, any plant species or plant cell can be selected as described further below.

Oils of the present invention can be obtained from canola cultivars producing DHA and/or EPA in seed oil of a *Brassica* species where the oils have a fatty acid content comprising, by weight, 70% or greater of oleic acid (C18:1) and/or 4% or lower linolenic acid (C18:3). Such oils are heart healthy and have increased stability for foodservice and consumer packaged goods applications. Such oils also reduce the need for hydrogenation and provide nutritional advantages relative to soy, palm and many other oils used by the food industry. The oxidative stability of such oils can be further increased by the addition of antioxidants and processing additives known in the art.

The oils of the present invention can also be used in non-culinary or dietary processes and compositions. Some of these uses can be industrial, cosmetic or medical. Oils of the present invention can also be used in any application for which the oils of the present invention are suited. In general, the oils of the present invention can be used to replace, e.g., mineral oils, esters, fatty acids, or animal fats in a variety of applications, such as lubricants, lubricant additives, metal working fluids, hydraulic fluids and fire resistant hydraulic fluids. The oils of the present invention can also be used as materials in a process of producing modified oils. Examples of techniques for modifying oils of the present invention include fractionation, hydrogenation, alteration of the oil's oleic acid or linolenic acid content, and other modification techniques known to those of skill in the art.

Examples of cosmetic uses for oils of the present invention include use as an emollient in a cosmetic composition; as a petroleum jelly replacement; as comprising part of a soap, or as a material in a process for producing soap; as comprising part of an oral treatment solution; as comprising part of an ageing treatment composition; and as comprising part of a skin or hair aerosol foam preparation.

Additionally, the oils of the present invention can be used in medical applications. For example, oils of the present invention can be used in a protective barrier against infection and oils high in omega-9 fatty acids can be used to enhance transplant graft survival (U.S. Pat. No. 6,210,700).

It should be understood that the foregoing are non-limiting examples of non-culinary uses for which the oils of the present invention are suited. As previously stated, oils and modified oils of the present invention can be used to replace, e.g., mineral oils, esters, fatty acids, or animal fats in all applications known to those of skill in the art.

PUFA Synthase System

The "standard" or "classical" pathway for synthesis of long chain. PUFAs (LC-PUFAs) in eukaryotic organisms involves the elongation and desaturation of medium chain-length saturated or mono-unsaturated fatty acids and has been described. The pathway for synthesis of long chain PUFAs via a PUFA synthase system has also been described and is very different from the "standard" pathway. Specifically, PUFA synthases utilize malonyl-CoA as a carbon source and produce the final PUFA without releasing intermediates in any significant amount. Also, with PUFA synthases, the appropriate cis double bonds are added during the synthesis using a mechanism that does not require oxygen. In some embodiments, NADPH is used as a reductant during the synthesis cycles.

The present invention relates to host organisms (e.g., plants) that have been genetically modified to express a PUFA synthase system (either endogenously or by genetic manipulation). In some embodiments, an organism that has been genetically modified to express a PUFA synthase system, wherein the organism does not naturally (endogenously, without genetic modification) express such a system, or at least that particular PUFA synthase or portion thereof with which the organism is being genetically modified, can be referred to herein as a "heterologous" host organism with regard to the modification of the organism with the PUFA synthase or with another protein that is not endogenously expressed by the organism. The genetic modifications of the present invention can be used to improve PUFA production in a host organism that endogenously expresses a PUFA synthase system, where the organism is not further modified with a different PUFA synthase or a portion thereof.

A PUFA synthase system according to the present invention can comprise several multifunctional proteins (and can include single function proteins, particularly for PUFA synthase systems from marine bacteria) that can act together to conduct both iterative processing of the fatty acid chain as well non-iterative processing, including trans-cis isomerization and enoyl reduction reactions in selected cycles. These proteins can also be referred to herein as the core PUFA synthase enzyme complex or the core PUFA synthase system. The general functions of the domains and motifs contained within these proteins are individually known in the art and have been described in detail with regard to various PUFA synthase systems from marine bacteria and eukaryotic organisms (see, e.g., U.S. Pat. Nos. 6,140,486; 6,566,583; Metz et al., Science 293:290-293 (2001); U.S. Appl. Pub. No. 2002/0194641; U.S. Appl. Pub. No. 2004/0235127; U.S. Appl. Pub. No. 2005/0100995, and WO 2006/135866). The domains can be found as a single protein (e.g., the domain and protein are synonymous) or as one of two or more (multiple) domains in a single protein, as mentioned above. The domain architecture of various PUFA synthases from marine bacteria and members of *Thraustochytrium*, and the structural and functional characteristics of genes and proteins comprising such PUFA synthases, have been described (see, e.g., U.S. Pat. Nos. 6,140,486; 6,566,583; Metz et al., Science 293:290-293 (2001); U.S. Appl. Pub. No. 2002/0194641; U.S. Appl. Pub. No. 2004/0235127; U.S. Appl. Pub. No. 2005/0100995 and WO 2006/135866).

Numerous examples of polynucleotides, genes and polypeptides having PUFA synthase activity are known in the art and can be used in a genetically modified host disclosed herein. PUFA synthase proteins or domains that are useful in the present invention can include both bacterial and non-bacterial PUFA synthases. A non-bacterial PUFA synthase is a system that is from or derived from an organism that is not a bacterium, such as a eukaryote. Bacterial PUFA synthases are described, for example, in U.S. Appl. Pub. No. 2008/0050505. Genetically modified plants of the invention can be produced which incorporate non-bacterial PUFA synthase functional domains with bacterial PUFA synthase functional domains, as well as PUFA synthase functional domains or proteins from other PKS systems (Type I iterative or modular, Type II, or Type III) or FAS systems.

In some embodiments, a PUFA synthase system of the present invention comprises at least the following biologically active domains that are typically contained on three or more proteins (a) at least one enoyl-ACP reductase (ER) domain; (b) multiple acyl carrier protein (ACP) domain(s) (e.g., at least from one to four, and preferably at least five ACP domains, and in some embodiments up to six, seven, eight, nine, ten, or more than ten ACP domains); (c) at least two β-ketoacyl-ACP synthase (KS) domains; (d) at least one acyltransferase (AT) domain; (e) at least one β-ketoacyl-ACP reductase (KR) domain; (f) at least two FabA-like β-hydroxyacyl-ACP dehydrase (DH) domains; (g) at least one chain length factor (CLF) domain; (h) at least one malonyl-CoA:ACP acyltransferase (MAT) domain. In some embodiments, a PUFA synthase system according to the present invention also comprises at least one region containing a dehydratase (DH) conserved active site motif.

In some embodiments, a PUFA synthase system comprises at least the following biologically active domains (a) at least one enoyl-ACP reductase (ER) domain; (b) at least five acyl carrier protein (ACP) domains; (c) at least two β-ketoacyl-ACP synthase (KS) domains; (d) at least one acyltransferase (AT) domain; (e) at least one β-ketoacyl-ACP reductase (KR) domain; (f) at least two FabA-like β-hydroxyacyl-ACP dehydrase (DH) domains; (g) at least one chain length factor (CLF) domain; and (h) at least one malonyl-CoA:ACP acyltransferase (MAT) domain. In some embodiments, a PUFA synthase system according to the present invention also comprises at least one region or domain containing a dehydratase (DH) conserved active site motif that is not a part of a FabA-like DH domain. The structural and functional characteristics of each of these domains are described in detail in U.S. Appl. Pub. No.

2002/0194641; U.S. Appl. Pub. No. 2004/0235127; U.S. Appl. Pub. No. 2005/0100995; U.S. Appl. Pub. No. 2007/0245431 and WO 2006/135866.

There are three open reading frames that form the core *Schizochytrium* PUFA synthase system and that have been described previously, e.g., in U.S. Appl. Pub. No. 2007/0245431. The domain structure of each open reading frame is as follows.

*Schizochytrium* Open Readin Frame A (OrfA or Pfa1):

OrfA is a 8730 nucleotide sequence (not including the stop codon) which encodes a 2910 amino acid sequence. Within OrfA are twelve domains (a) one β-keto acyl-ACP synthase (KS) domain; (b) one malonyl-CoA:ACP acyltransferase (MAT) domain; (c) nine acyl carrier protein (ACP) domains; and (d) one ketoreductase (KR) domain. Genomic DNA clones (plasmids) encoding OrfA from both *Schizochytrium* sp. ATCC 20888 and a daughter strain of ATCC 20888, denoted *Schizochytrium* sp., strain N230D, have been isolated and sequenced.

Genomic clone pJK1126 (denoted pJK1126 OrfA genomic clone, in the form of an *E. coli* plasmid vector containing "OrfA" gene from *Schizochytrium* ATCC 20888) was deposited with the American Type Culture Collection (ATCC), 10801 University Boulevard, Manassas, Va. 20110-2209 USA on Jun. 8, 2006, and assigned ATCC Accession No. PTA-7648.

Genomic clone pJK306 (denoted pJK306 OrfA genomic clone, in the form of an *E. coli* plasmid containing 5' portion of OrfA gene from *Schizochytrium* sp. N230D (2.2 kB overlap with pJK320)) was deposited with the American Type Culture Collection (ATCC), 10801 University Boulevard, Manassas, Va. 20110-2209 USA on Jun. 8, 2006, and assigned ATCC Accession No. PTA-7641.

Genomic clone pJK320 (denoted pJK320 OrfA genomic clone, in the form of an *E. coli* plasmid containing 3' portion of OrfA gene from *Schizochytrium* sp. N230D (2.2 kB overlap with pJK306)) was deposited with the American Type Culture Collection (ATCC), 10801 University Boulevard, Manassas, Va. 20110-2209 USA on Jun. 8, 2006, and assigned ATCC Accession No. PTA-7644.

*Schizochytrium* Open Reading Frame B (OrfB or Pfa2):

OrfB is a 6177 nucleotide sequence (not including the stop codon) which encodes a 2059 amino acid sequence. Within OrfB are four domains: (a) one-keto acyl-ACP synthase (KS) domain; (b) one chain length factor (CLF) domain; (c) one acyl transferase (AT) domain; and, (d) one enoyl ACP-reductase (ER) domain. Genomic DNA clones (plasmids) encoding OrfB from both *Schizochytrium* sp. ATCC 20888 and a daughter strain of ATCC 20888, denoted *Schizochytrium* sp., strain N230D, have been isolated and sequenced.

Genomic clone pJK1129 (denoted pJK1129 OrfB genomic clone, in the form of an *E. coli* plasmid vector containing "OrfB" gene from *Schizochytrium* ATCC 20888) was deposited with the American Type Culture Collection (ATCC), 10801 University Boulevard, Manassas, Va. 20110-2209 USA on Jun. 8, 2006, and assigned ATCC Accession No. PTA-7649.

Genomic clone pJK324 (denoted pJK324 OrfB genomic clone, in the form of an *E. coli* plasmid containing the OrfB gene sequence from *Schizochytrium* sp. N230D) was deposited with the American Type Culture Collection (ATCC), 10801 University Boulevard, Manassas, Va. 20110-2209 USA on Jun. 8, 2006, and assigned ATCC Accession No. PTA-7643.

*Schizochytrium* Open Reading Frame C (OrfC or Pfa3):

OrfC is a 4506 nucleotide sequence (not including the stop codon) which encodes a 1502 amino acid sequence. Within OrfC are three domains: (a) two FabA-like-hydroxy acyl-ACP dehydrase (DH) domains; and (b) one enoyl ACP-reductase (ER) domain. Genomic DNA clones (plasmids) encoding OrfC from both *Schizochytrium* sp. ATCC 20888 and a daughter strain of ATCC 20888, denoted *Schizochytrium* sp., strain N230D, have been isolated and sequenced.

Genomic clone pJK1131 (denoted pJK1131 OrfC genomic clone, in the form of an *E. coli* plasmid vector containing "OrfC" gene from *Schizochytrium* ATCC 20888) was deposited with the American Type Culture Collection (ATCC), 10801 University Boulevard, Manassas, Va. 20110-2209 USA on Jun. 8, 2006, and assigned ATCC Accession No. PTA-7650.

Genomic clone pBR002 (denoted pBR002 OrfC genomic clone, in the form of an *E. coli* plasmid vector containing the OrfC gene sequence from *Schizochytrium* sp. N230D) was deposited with the American Type Culture Collection (ATCC), 10801 University Boulevard, Manassas, Va. 20110-2209 USA on Jun. 8, 2006, and assigned ATCC Accession No. PTA-7642.

In addition, there are three open reading frames that form the core *Thraustochytrium* PUFA synthase that have been described previously. The domain structure of each open reading frame is as follows.

*Thraustochytrium* 23B Open Reading Frame A (OrfA):

OrfA is a 8433 nucleotide sequence (not including the stop codon) which encodes a 2811 amino acid sequence. The following domains are present in Th. 23B OrfA (a) one β-ketoacyl-ACP synthase (KS) domain; (b) one malonyl-CoA:ACP acyltransferase (MAT) domain; (c) eight acyl carrier protein (ACP) domains; and (d) one β-ketoacyl-ACP reductase (KR) domain.

Genomic clone Th23BOrfA_pBR812.1 (denoted Th23BOrfA_pBR812.1 genomic clone, in the form of an *E. coli* plasmid vector containing the OrfA gene sequence from *Thraustochytrium* 23B) was deposited with the American Type Culture Collection (ATCC), University Boulevard, Manassas, Va. 20110-2209 USA on Mar. 1, 2007, and assigned ATCC Accession No. PTA-8232. Genomic clone Th23BOrfA_pBR811 (denoted Th23BOrfA_pBR811 genomic clone, in the form of an *E. coli* plasmid vector containing the OrfA gene sequence from *Thraustochytrium* 23B) was deposited with the American Type Culture Collection (ATCC), 10801 University Boulevard, Manassas, Va. 20110-2209 USA on Mar. 1, 2007, and assigned ATCC Accession No. PTA-8231.

*Thraustochytrium* 23B Open Reading Frame B (OrfB):

OrfB is a 5805 nucleotide sequence (not including the stop codon) that encodes a 1935 amino acid sequence. The following domains are present in Th. 23B OrfB (a) one β-ketoacyl-ACP synthase (KS) domain; (b) one chain length factor (CLF) domain; (c) one acyltransferase (AT) domain; and, (d) one enoyl-ACP reductase (ER) domain. Genomic clone Th23BOrfB_OR800 (denoted Th23BOrfB_pBR800 genomic clone, in the form of an *E. coli* plasmid vector containing the OrfB gene sequence from *Thraustochytrium* 23B) was deposited with the American Type Culture Collection (ATCC), 10801 University Boulevard, Manassas, Va. 20110-2209 USA on Mar. 1, 2007, and assigned ATCC Accession No, PTA-8227.

*Thraustochytrium* 23B Open Reading Frame C (OrfC):

OrfC is a 4410 nucleotide sequence (not including the stop codon) that encodes a 1470 amino acid sequence. The following domains are present in Th. 23B OrfC: (a) two FabA-like β-hydroxyacyl-ACP dehydrase (DH) domains, both with homology to the FabA protein (an enzyme that catalyzes the synthesis of trans-2-decenoyl-ACP and the reversible isomerization of this product to cis-3-decenoyl-ACP); and (b) one enoyl-ACP reductase (ER) domain with high homology to the ER domain of Schizochytrium OrfB. Genomic clone Th23BOrfC_pBR709A (denoted Th23BOrfC_pBR709A genomic clone, in the form of an E. coli plasmid vector containing the OrfC gene sequence from Thraustochytrium 23B) was deposited with the American Type Culture Collection (ATCC), 10801 University Boulevard, Manassas, Va. 20110-2209 USA on Mar. 1, 2007, and assigned ATCC Accession No. PTA-8228.

Chimeric or Hybrid PUFA Synthase Systems:

In some embodiments, the PUFA synthase system comprises domains selected from any of those described herein, wherein the domains are combined (e.g., mixed and matched) to form a complete PUFA synthase system meeting the minimum requirements described herein. In some embodiments, the genetically modified organism of the invention can be further modified with at least one domain or biologically active fragment thereof of another PUFA synthase system. In some embodiments, any of the domains of a PUFA synthase system can be modified from their natural structure to modify or enhance the function of that domain in the PUFA synthase system (e.g., to modify the PUFA types or ratios thereof produced by the system). Such mixing of domains to produce chimeric PUFA synthase systems is described in the patents and publications referenced herein.

In some embodiments, the PUFA synthase system comprises a Schizochytrium PUFA synthase system wherein OrfC from the Schizochytrium PUFA synthase system is replaced with OrfC from Thraustochytrium 23B. In some embodiments, such a chimeric OrfC from Thraustochytrium 23B is encoded by a nucleic acid sequence that is optimized for Schizochytrium codon usage. As a non-limiting example of such a chimeric OrfC, plasmid pThOrfC-synPS (denoted pThOrfC-synPS, in the form of an E. coli plasmid vector containing a "perfect stitch" synthetic Thraustochytrium 23B PUFA PKS OrfC codon optimized for expression in Schizochytrium or other heterologous hosts) was deposited with the American Type Culture Collection (ATCC), 10801 University Boulevard, Manassas, Va. 20110-2209 USA on Mar. 1, 2007, and assigned ATCC Accession No. PTA-8229 (see also U.S. Appl. Pub. No. 2008/0022422).

Other examples of PUFA synthase genes and polypeptides that can be used in a genetically modified organism of the invention include, but are not limited to, the following codon-optimized sequences generated by the methods described further herein: SEQ ID NO:1 (SzPUFA OrfA v3 protein); SEQ ID NO:2 (SzPUFA OrfB v3 protein); SEQ ID NO:3 (hSzThPUFA OrfC v3 protein); SEQ ID NO:6 (SzPUFA OrfA gene); SEQ ID NO:7 (SzPUFA OrfB v3 gene); and SEQ ID NO:8 (hSzThPUFA OrfC v3 gene), as well as an active variant, portion, fragment, or derivative of such sequences, wherein such a gene encodes, or such a polypeptide or protein has, PUFA synthase activity. The present invention includes an isolated polynucleotide or polypeptide comprising or consisting of one or more of such sequences.

Other examples of PUFA synthase genes and polypeptides that can be used in a genetically modified organism of the invention include, but are not limited to, PUFA synthase genes or polypeptides having 60%, 65%, 70%, 75%, 80%, 85%, 90%, 95%, 96%, 97%, 98%, 99% or 100% sequence identity to any one of the PUFA synthases or sequences described herein. Useful ranges can be selected between any of these values (for example, 60% to 99%, 65% to 95%, 70% to 95%, 75% to 95%, 80% to 95%, 85% to 95%, or 90% to 99%). Still other examples of PUFA synthase genes and polypeptides that can used in a genetically modified organism of the invention include, but are not limited to an active variant, portion, fragment of derivative of any one of the PUFA synthases or sequences described herein, wherein such a gene encodes, or such a polypeptide has, PUFA synthase activity.

In some embodiments, the PUFA synthase system can be an algal PUFA synthase. In some embodiments, the PUFA synthase system can comprise an amino acid sequence that is at least 60% to 99% identical to the amino acid sequence of SEQ ID NO:1. In some embodiments, the PUFA synthase system can comprise the amino acid sequence of SEQ ID NO:1. In some embodiments, the nucleic acid sequence encoding the PUFA synthase system can comprise a nucleic acid sequence at least 60% to 99% identical to the nucleic acid sequence of SEQ ID NO:6. In some embodiments, the nucleic acid sequence encoding the PUFA synthase system can comprise the nucleic acid sequence of SEQ ID NO:6. In some embodiments, the PUFA synthase system can comprise an amino acid sequence that is at least 80% identical to the amino acid sequence of SEQ ID NO:2. In some embodiments, the PUPA synthase system can comprise the amino acid sequence of SEQ ID NO:2. In some embodiments, the nucleic acid sequence encoding the PUPA synthase system can comprise a nucleic acid sequence that is at least 80% identical to the nucleic acid sequence of SEQ ID NO:7. In some embodiments, the nucleic acid sequence encoding the PUPA synthase system can comprise the nucleic acid sequence of SEQ ID NO:7. In some embodiments, the PUPA synthase system can comprise an amino acid sequence that is at least 80% identical to the amino acid sequence of SEQ ID NO:3. In some embodiments, the PUFA synthase system comprises the amino acid sequence of SEQ ID NO:3. In some embodiments, the nucleic acid sequence encoding the PUPA synthase system comprises a nucleic acid sequence that is at least 80% identical to the nucleic acid sequence of SEQ ID NO:8. In some embodiments, the nucleic acid sequence encoding the PUFA synthase system comprises the nucleic acid sequence of SEQ ID NO:8.

In some embodiments, the PUPA synthase system comprises the amino acid sequence of SEQ ID NO:1, 2, or 3 or any combinations thereof. In some embodiments, the PUFA synthase system comprises the nucleic acid sequence of SEQ ID NO:6, 7, or 8 or any combinations thereof.

In some embodiments, the sequences of other PUPA synthase genes and/or polypeptides can be identified in the literature and in bioinformatics databases well known to the skilled person using sequences disclosed herein and available in the art. For example, such sequences can be identified through BLAST searching of publicly available databases with known PUPA synthase gene or polypeptide sequences. In such a method, identities can be based on the Clustal W method of alignment using the default parameters of GAP PENALTY=1.0, GAP LENGTH PENALTY=0.1, and Gonnet 250 series of protein weight matrix.

Additionally, the PUPA synthase gene or polypeptide sequences disclosed herein or known the art can be used to identify other PUFA synthase homologs in nature. For example, each of the PUPA synthase nucleic acid fragments disclosed herein can be used to isolate genes encoding homologous proteins. Isolation of homologous genes using sequence-dependent protocols is well known in the art. Examples of sequence-dependent protocols include, but are not limited to (1) methods of nucleic acid hybridization; (2) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor, S. et al., Proc. Acad. Sci. USA 82:1074 (1985); or strand displacement amplification (SDA), Walker et al., Proc. Natl. Acad. Sci. U.S.A., 89:392 (1992)]; and (3) methods of library construction and screening by complementation.

All of these methods can be readily practiced by one skilled in the art making use of the known or identified sequences encoding target proteins. In some embodiments, DNA sequences surrounding a target PUFA synthase coding sequence are also useful in some modification procedures and can be readily found by one of skill in the art in publicly available databases. Methods for creating genetic mutations are common and well known in the art and can be applied to the exercise of creating mutants.

Phosphopantethienyl Transferase

The phosphopantethienyl transferases (PPTases) are a family of enzymes that have been well characterized in fatty acid synthesis, polyketide synthesis, and non-ribosomal peptide synthesis. In particular, the ACP domains present in the PUFA synthase enzymes require activation by attachment of a cofactor (4-phosphopantetheine) from coenzyme A to the acyl carrier protein (ACP). Attachment of this cofactor is carried out by PPTases. If the endogenous PPTases of the host organism are incapable of activating the PUFA synthase ACP domains, then it is necessary to provide a PPTase that is capable of carrying out that function. The sequences of many PPTases are known, and crystal structures have been determined (e.g., Reuter et al., EMBO J. 18:6823-31 (1999)) as well as mutational analysis of amino acid residues important for activity (Mofid et al., Biochemistry 43:4128-36 (2004)).

One example of a heterologous PPTase which has been demonstrated previously to recognize the OrfA ACP domains described herein as substrates is the Het I protein of Nostoc sp. PCC 7120 (formerly called Anabaena sp. PCC 7120). Het I is present in a cluster of genes in Nostoc known to be responsible for the synthesis of long chain hydroxyfatty acids that are a component of a glyco-lipid layer present in heterocysts of that organism (Black and Wolk, J. Bacteriol. 176:2282-2292 (1994); Campbell et al., Arch. Microbiol. 167:251-258 (1997)). Het I is likely to activate the ACP domains of a protein, Hgl E, present in that cluster. The two ACP domains of Hgl E have a high degree of sequence homology to the ACP domains found in Schizochytrium Orf A and other PUFA synthases.

In some embodiments, a PUFA synthase can be considered to include at least one 4'-phosphopantetheinyl transferase (PPTase) domain, or such a domain can be considered to be an accessory domain or protein to the PUFA synthase. Structural and functional characteristics of PPTases have been described in detail, for example, in U.S. Appl. Pub. No. 2002/0194641; U.S. Appl. Pub. No. 2004/0235127; and U.S. Appl. Pub. No. 2005/0100995.

Numerous examples of genes and polypeptides having PPTase activity are known in the art and could be used in a genetically modified organism of the invention if they are capable of activating the ACP domains of the particular PUFA synthase being used. Examples of genes and polypeptides that can be used in a genetically modified organism of the invention can include, but are not limited to, the following codon-optimized sequences described further herein: SEQ ID NO:5 (NoHetI v3 protein) and SEQ ID NO:10 (NoHetI v3 gene).

Other examples of PPTase genes and polypeptides that can be used in a genetically modified organism of the invention include, but are not limited to, PPTase genes or polypeptides having 60%, 65%, 70%, 75%, 80%, 85%, 90%, 95%, 96%, 97%, 98%, 99% or 100% sequence identity to any one of the PPTases or sequences described herein. Useful ranges can be selected between any of these values (for example, 60% to 99%, 65% to 95%, 70% to 95%, 75% to 95%, 80% to 95%, 85% to 95%, 90% to 99%). Still other examples of PPTase genes and polypeptides that can used in a genetically modified organism of the invention include, but are not limited to an active variant, fragment, portion or derivative of any one of the PPTase sequences described herein, wherein such a gene encodes, or such a polypeptide has, PPTase activity.

In some embodiments, the PPTase can be an algal PPTase. In some embodiments, the PPTase can comprise an amino acid sequence that is at least 60% to 99% identical to the amino acid sequence of SEQ ID NO:5. In some embodiments, the PPTase can comprise the amino acid sequence of SEQ ID NO:5. In some embodiments, the nucleic acid sequence encoding the algal PPTase can comprise a nucleic acid sequence at least 60% to 99% identical to the nucleic acid sequence of SEQ ID NO:10. In some embodiments, the nucleic acid sequence encoding the algal PPTase can comprise the nucleic acid sequence of SEQ ID NO:10.

In some embodiments of the present invention, a PPTase can be provided for production and/or accumulation of PPTase in a heterologous host.

In some embodiments, a gene and/or polypeptide encoding PPTase can be used to identify another PPTase gene and/or polypeptide sequences and/or can be used to identify a PPTase homolog in other cells. Such PPTase encoding sequences can be identified, for example, in the literature and/or in bioinformatics databases well known to the skilled person. For example, the identification of a PPTase encoding sequence in another cell type using bioinformatics can be accomplished through BLAST (as disclosed above) searching of publicly available databases with a known PPTase encoding DNA and polypeptide sequence, such as any of those provided herein. Identities are based on the Clustal W method of alignment using the default parameters of GAP PENALTY=10, GAP LENGTH PENALTY=0.1, and Gonnet 250 series of protein weight matrix.

In some embodiments, the genetically modified plant (e.g., Brassica), descendant, cell, tissue, or part thereof contains the nucleic acid sequences of (i) and (ii) in a single recombinant expression vector.

Acyl-CoA Synthetase

The present invention provides acyl-CoA synthetase (ACoAS) proteins that catalyze the conversion of long chain PUFA free fatty acids (FFA) to acyl-CoA. The endogenous producer of PUFAs by PUFA synthase, Schizochytrium, possesses one or more ACoASs that are capable of converting the free fatty acid products of its PUFA synthase into acyl-CoA. This is evident by the fact that high levels of PUFAs accumulate in those fractions in this organism. Therefore, Schizochytrium, as well as other organisms that endogenously contain a PUFA synthase (e.g., other Thraustochytrids) or other organisms that can convert PUFA FFAs into acyl-COAs (such as Thalassiosira pseudonana or Crypthecodinium cohnii), could represent sources for genes encoding enzymes that are useful in permitting or increasing the accumulation of the products of a PUFA synthase expressed in a heterologous host. Other ACoAS sequences have been described in U.S. Appl. Pub. No. 2007/0245431.

Numerous examples of genes and polypeptides having ACoAS activity are known in the art and can be used in a genetically modified organism of the invention. Examples of genes and polypeptides that can be used in a genetically modified organism of the invention can include, but are not limited to, the following codon-optimized sequences described further herein: SEQ ID NO:4 (SzACS-2 v3 protein) and SEQ ID NO:9 (hSzThACS-2 v3 gene).

Other examples of ACoAS genes and polypeptides that can be used in a genetically modified organism of the invention include, but are not limited to, ACoAS genes or polypeptides having 60%, 65%, 70%, 75%, 80%, 85%, 90%, 95%, 96%, 97%, 98%, 99% or 100% sequence identity to any one of the ACoAS or sequences described herein. Useful ranges can be selected between any of these values (for example, 60% to 99%, 65% to 95%, 70% to 95%, 75% to 95%, 80% to 95%, 85% to 95%, 90% to 99%). Still other examples of ACoAS genes and polypeptides that can used in a genetically modified organism of the invention include, but are not limited to an active variant, fragment, portion, or derivative of any one of the ACoAS sequences described herein, wherein such a gene encodes, or such a polypeptide has, ACoAS activity.

In some embodiments, the ACoAS can be an algal ACoAS. In some embodiments, the ACoAS can comprise an amino acid sequence that is at least 60% to 99% identical to the amino acid sequence of SEQ ID NO:4. In some embodiments, the ACoAS can comprise the amino acid sequence of SEQ ID NO:4. In some embodiments, the nucleic acid sequence encoding the algal ACoAS can comprise a nucleic acid sequence at least 60% to 99% identical to the nucleic acid sequence of SEQ ID NO:9. In some embodiments, the nucleic acid sequence encoding the algal ACoAS can comprise the nucleic acid sequence of SEQ ID NO:9. In some embodiments, the nucleic acid sequence encoding the ACoAS comprises the nucleic acid sequence of SEQ ID NO:34.

In some embodiments of the present invention, ACoAS can be provided for production and/or accumulation of ACoAS in a heterologous host as well as for improved production and/or accumulation of ACoAS in an endogenous host.

In some embodiments, a gene and/or polypeptide encoding ACoAS can be used to identify another ACoAS gene and/or polypeptide sequences and/or can be used to identify an ACoAS homolog in other cells. Such ACoAS encoding sequences can be identified, for example, in the literature and/or in bioinformatics databases well known to the skilled person. For example, the identification of a ACoAS encoding sequence in another cell type using bioinformatics can be accomplished through BLAST (as disclosed above) searching of publicly available databases with a known ACoAS encoding DNA and polypeptide sequence, such as any of those provided herein. Identities are based on the Clustal W method of alignment using the default parameters of GAP PENALTY=10, GAP LENGTH PENALTY=0.1, and Gonnet 250 series of protein weight matrix.

In some embodiments, the genetically modified plant (e.g., *Brassica*), descendant, cell, tissue, or part thereof comprises the nucleic acid sequences of (i), (ii) or (iii), or any combinations thereof, contained in a single recombinant expression vector. In some embodiments, the nucleic acid sequences of (i), (ii) or (iii), or any combinations thereof, are wider the control of one or more seed-specific promoters and/or are contained in a single recombinant expression vector.

Methods of Making Genetically Modified Organisms

To produce significantly high yields of one or more desired polyunsaturated fatty acids, an organism (e.g., a plant), can be genetically modified to introduce a PUFA synthase into the plant. The present invention also relates to methods to improve or enhance the effectiveness of such genetic modification and particularly, to improve or enhance the production and/or accumulation of the endproduct of a PUFA synthase, e.g., PUFA(s).

Methods for gene expression in a genetically modified organism, including, but not limited to plants, are known in the art. In some embodiments, the coding region for the PUFA synthase genes to be expressed can be codon optimized for the target host cell as described below. Expression of genes in recombinant host cells, including but not limited to plant cells, can require a promoter operably linked to a coding region of interest, and/or a transcriptional terminator. A number of promoters can be used in constructing vectors for genes, including but not limited to a seed-specific promoter (e.g., PvDlec2, LfKCS3 and FAE 1). Other non-limiting examples of promoters that can be used in the present invention include the acyl carrier protein promoter disclosed in WO 1992/18634; the *Phaseolus vulgaris* beta-phaseolin promoter and truncated versions disclosed in Slightom et al. (*Proc. Natl. Acad. Sci. U.S.A.* 80:1897-1901; 1983); Sengupta-Gopalan et al. (*Proc. Nat. Acad. Sci.* 82:3320-3324; 1985); van der Geest et al. (*Plant Mol. Biol.* 33:553-557; 1997), and Bustos et al. (*EMBO J.* 10:1469-1479; 1991).

In some embodiments of the present invention, a recombinant vector is an engineered (e.g., artificially produced) nucleic acid molecule that is used as a tool for manipulating a nucleic acid sequence of choice and for introducing such a nucleic acid sequence into a host cell. The recombinant vector is therefore suitable for use in cloning, sequencing, and/or otherwise manipulating the nucleic acid sequence of choice, such as by expressing and/or delivering the nucleic acid sequence of choice into a host cell to form a recombinant cell. Such a vector typically contains heterologous nucleic acid sequences, that is nucleic acid sequences that are not naturally found adjacent to nucleic acid sequence to be cloned or delivered, although the vector can also contain regulatory nucleic acid sequences (e.g., promoters, untranslated regions) which are naturally found adjacent to nucleic acid molecules of the present invention or which are useful for expression of the nucleic acid molecules of the present invention. The vector can be either RNA or DNA, either prokaryotic or eukaryotic, and typically is a plasmid. The vector can be maintained as an extrachromosomal element (e.g., a plasmid) or it can be integrated into the chromosome of a recombinant organism (e.g., a microbe or a plant). The entire vector can remain in place within a host cell, or under certain conditions, the plasmid DNA can be deleted, leaving behind the nucleic acid molecule of the present invention. The integrated nucleic acid molecule can be under chromosomal promoter control, under native or plasmid promoter control, or under a combination of several promoter controls. Single or multiple copies of the nucleic acid molecule can be integrated into the chromosome. A recombinant vector of the present invention can contain at least one selectable marker.

In some embodiments, a recombinant vector used in a recombinant nucleic acid molecule of the present invention is an expression vector. In such an embodiment, a nucleic acid sequence encoding the product to be produced (e.g., a PUFA synthase) is inserted into the recombinant vector to produce a recombinant nucleic acid molecule. The nucleic acid sequence encoding the protein to be produced is inserted into the vector in a manner that operatively links the nucleic acid sequence to regulatory sequences in the vector that enable the transcription and translation of the nucleic acid sequence within the recombinant host cell.

Vectors useful for the transformation of a variety of host organisms and cells are common and disclosed in the literature. Typically the vector contains a selectable marker and sequences allowing autonomous replication or chromosomal integration in the desired host. In addition, suitable vectors can comprise a promoter region which harbors transcriptional initiation controls and a transcriptional termination control region, between which a coding region DNA fragment can be inserted, to provide expression of the inserted coding region. Both control regions can be derived from genes homologous to the transformed host cell, although it is to be understood that such control regions can also be derived from genes that are not native to the specific species chosen as a production host.

The present invention includes the expression of one or more acyl-CoA synthetases as described and exemplified herein with a PUFA synthase as described herein and with an exogenous PPTase which are utilized alone or in combination with any one or more strategies described herein (e.g., any one, two, three, or four of: codon optimization, organelle-targeting, enhancement of PUFA synthase competition for malonyl CoA (e.g., by inhibition of FAS), and/or expression of one or more acyltransferases or related enzymes), to increase PUFA production and/or accumulation in a heterologous host.

Some embodiments of the invention relate to the targeting of expression of the PUFA synthase enzymes, the PPTase, and/or any one or more of the accessory proteins and/or targeted genetic modifications to one or more organelles of the host. For example, in some embodiments, expression of the PUFA synthase system and the PPTase can be targeted to the plastid of a plant. In some embodiments, expression of the PUFA synthase and the PPTase is targeted to the cytosol. In some embodiments, expression of the PUFA synthase and the PPTase is targeted to both the plastid and the cytosol of a plant. In any of these embodiments, other targets can be directed to the plastid or the cytosol.

In some embodiments, acyl-CoA synthetases are expressed in the cytosol to convert the DHA and/or other LC-PUFA free fatty acids to acyl-CoAs, which in turn can be utilized by the acyltransferases.

One exemplary plastid targeting sequence is derived from a *Brassica napus* acyl-ACP thioesterase and is described in U.S. Appl. Pub. No. 2007/0245431. A variety of other plastid targeting sequences are known in the art and can be used in embodiments where the heterologous host is a plant or plant cell, and wherein targeting to the plastid is desired.

The present invention includes the use of organelle targeting (e.g., to the plastid or chloroplast in plants) with expression of a PUFA synthase as described herein and with an exogenous PPTase, which are utilized alone or in combination with any one or more strategies described herein (e.g., any one, two, three, or four of: codon optimization, enhancement of PUFA synthase competition for malonyl CoA (e.g., by inhibition of FAS), expression of one or more acyl-CoA synthetases, and/or expression of one or more acyltransferases or related enzymes), to increase PUFA production and/or accumulation in a heterologous host.

The targeting of gene products to the plastid or chloroplast is controlled by a signal sequence found at the amino terminal end of various proteins and which is cleaved during import yielding the mature protein (e.g., with regard to chloroplast targeting, see, e.g., Comai et al., *J Biol. Chem.* 263:15104-15109 (1988)). These signal sequences can be fused to heterologous gene products to effect the import of heterologous products into the chloroplast (van den Broeck et al. *Nature* 313:358-363 (1985)). DNA encoding for appropriate signal sequences can be isolated from the cDNAs encoding the RUBISCO protein, the CAB protein, the EPSP synthase enzyme, the GS2 protein and many other proteins which are known to be chloroplast localized.

In some embodiments of the invention, the localization of proteins employed in the invention is directed to a subcellular compartment, for example, to the plastid or chloroplast. Proteins can be directed to the chloroplast by including at their amino-terminus a chloroplast transit peptide (CTP). Similarly, proteins can be directed to the plastid by including at their N-terminus a plastid transit or signaling peptide.

Naturally occurring chloroplast targeted proteins, synthesized as larger precursor proteins containing an amino-terminal chloroplast targeting peptide directing the precursor to the chloroplast import machinery, are well known in the art. Chloroplast targeting peptides are generally cleaved by specific endoproteases located within the chloroplast organelle, thus releasing the targeted mature and preferably active enzyme from the precursor into the chloroplast milieu. Examples of sequences encoding peptides which are suitable for directing the targeting of the gene or gene product to the chloroplast or plastid of the plant cell include the petunia EPSPS CTP, the *Arabidopsis* EPSPS CTP2 and intron, and others known to those skilled in the art. Such targeting sequences provide for the desired expressed protein to be transferred to the cell structure in which it most effectively functions, or by transferring the desired expressed protein to areas of the cell in which cellular processes necessary for desired phenotypic function are concentrated. Specific examples of chloroplast targeting peptides are well known in the art and include the *Arabidopsis thaliana* ribulose bisphosphate carboxylase small subunit ats1A transit peptide, an *Arabidopsis thaliana* EPSPS transit peptide, and a *Zea maize* ribulose bisphosphate carboxylase small subunit transit peptide.

An optimized transit peptide is described, for example, by van den Broeck et al., *Nature,* 313:358-363 (1985). Prokaryotic and eukaryotic signal sequences are disclosed, for example, by Michaelis et al., *Ann. Rev. Microbiol.* 36:425 (1982). Additional examples of transit peptides that can be used in the invention include the chloroplast transit peptides such as those described in Von Heijne et al., *Plant Mol. Biol. Rep.* 9:104-126 (1991); Mazur et al., *Plant Physiol.* 85:1110 (1987); Vorst et al., *Gene* 65:59 (1988). Chen & Jagendorf (*J Biol. Chem.* 268:2363-2367 (1993)) have described use of a chloroplast transit peptide for import of a heterologous transgene. This peptide used is the transit peptide from the rbcS gene from *Nicotiana plumbaginifolia* (Poulsen et al. *Mol. Gen. Genet.* 205: 193-200 (1986)). One CTP that has functioned herein to localize heterologous proteins to the chloroplast was derived from *Brassica napus* acyl-ACP thioesterase.

An alternative means for localizing genes to chloroplast or plastid includes chloroplast or plastid transformation. Recombinant plants can be produced in which only the chloroplast DNA has been altered to incorporate the molecules envisioned in this application. Promoters which function in chloroplasts are known in the art (Hanley-Bowden et al., *Trends in Biochemical Sciences* 12:67-70 (1987)). Methods and compositions for obtaining cells containing chloroplasts into which heterologous DNA has been inserted have been described, for example by Daniell et al. (U.S. Pat. No. 5,693,507) and Maliga et al. (U.S. Pat. No. 5,451,513).

Combinations of Strategies

According to the present invention, in the production of a heterologous host for the production and accumulation of one or more target PUFAs, any one or more (any combination) of the strategies described herein for improving the production and/or accumulation of PUFAs in the host can be used. Indeed, it is anticipated that various combinations of strategies will be additive or synergistic and provide improved production and/or accumulation of PUFAs as compared to in the absence of one or more such strategies. Indeed, the Examples provide exemplary strategies for the production of PUFAs in a host organism.

Any plant or plant cell using these combinations of modifications, or any other modification or combination of modifications described herein, is encompassed by the invention. In some embodiments, such a plant has been further genetically modified to express an accessory protein as described herein for the improvement of the production and/or accumulation of PUFAs (or other bioactive products of the PUFA synthase) by the host (e.g., ACoAS, GPAT, LPAAT, DAGAT or acetyl CoA carboxylase (ACCase)). Furthermore, any host cell or organism using any modifications or combination of modifications described herein is encompassed by the invention, as are any products derived from such cell or organisms, including seed or oil comprising the target PUFAs.

In some embodiments, plants to genetically modify according to the present invention (e.g., plant host cells) includes, but is not limited to any higher plants, including both dicotyledonous and monocotyledonous plants, and particularly consumable plants, including crop plants and especially plants used for their oils. Such plants can include, but are not limited to, for example: canola, soybeans, rapeseed, linseed, corn, safflowers, sunflowers and tobacco. Thus, any plant species or plant cell can be selected. In embodiments, plant cells used herein, and plants grown or derived therefrom, include, but are not limited to, cells obtainable from canola (*Brassica napus*); oilseed rape (*Brassica napus*); indian mustard (*Brassica juncea*); Ethiopian mustard (*Brassica carinata*); turnip (*Brassica rapa*); cabbage (*Brassica oleracea*); soybean (*Glycine max*); linseed/flax (*Linum usitatissimum*); maize (corn) (*Zea mays*); safflower (*Carthamus tinctorius*); sunflower (*Helianthus annuus*); tobacco (*Nicotiana tabacum*); *Arabidopsis thaliana*, Brazil nut (*Betholettia excelsa*); castor bean (*Ricinus communis*); coconut (*Cocus nucifera*); coriander (*Coriandrum sativum*); cotton (*Gossypium* spp.); groundnut (*Arachis hypogaea*); jojoba (*Simmondsia chinensis*); oil palm (*Elaeis guineeis*); olive (*Olea eurpaea*); rice (*Oryza sativa*); squash (*Cucurbita maxima*); barley (*Hordeum vulgare*): wheat (*Triticum aestivum*); and duckweed (*Lemnaceae* sp.). In some embodiments, the genetic background within a plant species can vary.

"Plant parts," as used herein, include any parts of a plant, including, but not limited to, seeds (including mature seeds and immature seeds), pollen, embryos, flowers, fruits, shoots, leaves, roots, stems, explants, etc. In some embodiments, a genetically modified plant has a genome which is modified (e.g., mutated or changed) from its normal (e.g., wild-type or naturally occurring) form such that the desired result is achieved (e.g., increased or modified PUFA synthase and/or production and/or accumulation of a desired product using the PUFA synthase). In some embodiments, genetic modification of a plant can be accomplished using classical strain development and/or molecular genetic techniques. Methods for producing a transgenic plant, wherein a recombinant nucleic acid molecule encoding a desired amino acid sequence is incorporated into the genome of the plant, are known in the art. In some embodiments, a plant to genetically modify according to the present invention is a plant suitable for consumption by animals, including humans.

Plant lines from these plants, optimized for a particularly desirable trait, e.g. disease resistance, ease of plant transformation, oil content or profile, etc., can be produced, selected or identified. In some embodiments, plant lines can be selected through plant breeding, or through methods such as marker assisted breeding and tilling. In some embodiments, plant cell cultures can be used and, for example, are not grown into differentiated plants and cultivated using ordinary agricultural practices, but instead grown and maintained in a liquid medium.

In some embodiments, the plant can be an oil seed plant, wherein the oil seeds, and/or the oil in the oil seeds contain PUFAs produced by the PUFA synthase. In some embodiments, such oils can contain a detectable amount of at least one target or primary PUFA that is the product of the PUFA synthase. In some embodiments, such oils can be substantially free of intermediate or side products that are not the target or primary PUFA products and that are not naturally produced by the endogenous FAS system in the wild-type plants (e.g., wild-type plants produce some shorter or medium chain PUFAs, such as 18 carbon PUFAs, via the FAS system, but there will be new, or additional, fatty acids produced in the plant as a result of genetic modification with a PUFA synthase system).

With regard to the production of genetically modified plants, methods for the genetic engineering of plants are well known in the art. For instance, numerous methods for plant transformation have been developed, including a biological and physical transformation protocols for dicotyledenous plants as well as monocotyledenous plants (e.g., Goto-Fumiyuki et al., *Nature Biotech* 17:282-286 (1999); Miki et al., Methods in Plant Molecular Biology and Biotechnology, Glick, B. R. and Thompson, J. E. Eds., CRC Press, Inc., Boca Raton, pp. 67-88 (1993). In addition, vectors and in vitro culture methods for plant cell or tissue transformation and regeneration of plants are available, for example, in Gruber et al., Methods in Plant Molecular Biology and Biotechnology, Glick, B. R. and Thompson, J. E. Eds., CRC Press, Inc., Boca Raton, pp. 89-119 (1993).

The present invention is drawn to an isolated nucleic acid molecule comprising a nucleic acid sequence selected from SEQ ID NOs: 6-10 as well as an isolated nucleic acid molecule comprising a modification or mutation of such a sequence as described herein. The present invention is drawn to isolated polypeptides comprising an amino acid sequence selected from SEQ ID NOs: 1-5 as well as an isolated polypeptide comprising a modification or mutation or such a sequence as described herein.

The present invention includes a recombinant expression vector pDAB7361. The present invention includes a recombinant expression vector pDAB7362. The present invention includes a recombinant expression vector pDAB7363. The present invention includes a recombinant expression vector pDAB7365. The present invention includes a recombinant expression vector pDAB7368. The present invention includes a recombinant expression vector pDAB7369. The present invention includes a recombinant expression vector pDAB7370. The present invention includes a recombinant expression vector pDAB100518. The present invention includes a recombinant expression vector pDAB101476.

The present invention includes a recombinant expression vector pDAB9166. The present invention includes a recombinant expression vector pDAB9167. The present invention includes a recombinant expression vector pDAB7379. The present invention includes a recombinant expression vector pDAB7380. The present invention includes a recombinant expression vector pDAB9323. The present invention includes a recombinant expression vector pDAB9330. The present invention includes a recombinant expression vector pDAB9337. The present invention includes a recombinant expression vector pDAB9338. The present invention includes a recombinant expression vector pDAB9344. The present invention includes a recombinant expression vector pDAB9396. The present invention includes a recombinant expression vector pDAB101412. The present invention includes a recombinant expression vector pDAB7733. The present invention includes a recombinant expression vector pDAB7734. The present invention includes a recombinant expression vector pDAB101493. The present invention includes a recombinant expression vector pDAB109507. The present invention includes a recombinant expression vector pDAB109508. The present invention includes a recombinant expression vector pDAB109509. The present invention includes a recombinant expression vector pDAB9151. The present invention includes a recombinant expression vector pDAB108207. The present invention includes a recombinant expression vector pDAB108208. The present invention includes a recombinant expression vector pDAB108209. The present invention includes a recombinant expression vector pDAB9159. The present invention includes a recombinant expression vector pDAB9147. The present invention includes a recombinant expression vector pDAB108224. The present invention includes a recombinant expression vector pDAB108225.

As used herein, the term "transfection" is used to refer to any method by which an exogenous nucleic acid molecule (e.g., a recombinant nucleic acid molecule) can be inserted into a cell. The term "transformation" can be used interchangeably with the term "transfection" when such term is used to refer to the introduction of nucleic acid molecules into microbial cells, such as algae, bacteria and yeast, or into plant cells. In microbial and plant systems, the term "transformation" is used to describe an inherited change due to the acquisition of exogenous nucleic acids by the microorganism or plant and is essentially synonymous with the term "transfection." In some embodiments, transfection techniques include, but are not limited to, transformation, particle bombardment, diffusion, active transport, bath sonication, electroporation, microinjection, lipofection, adsorption, infection and protoplast fusion.

A widely utilized method for introducing an expression vector into plants is based on the natural transformation system of *Agrobacterium*. Horsch et al., *Science* 227:1229 (1985). *A. tumefaciens* and *A. rhizogenes* are plant pathogenic soil bacteria known to be useful to genetically transform plant cells. The Ti and Ri plasmids of *A. tumefaciens* and *A. rhizogenes*, respectively, carry genes responsible for genetic transformation of the plant. Kado, C. I., *Crit. Rev. Plant. Sci.* 10:1 (1991). Descriptions of *Agrobacterium* vector systems and methods for *Agrobacterium*-mediated gene transfer are also available, for example, Gruber et al., supra, Miki et al., supra, Moloney et al., *Plant Cell Reports* 8:238 (1989), and U.S. Pat. Nos. 4,940,838 and 5,464,763.

Another known method of plant transformation is microprojectile-mediated transformation wherein DNA is carried on the surface of microprojectiles. In this method, the expression vector is introduced into plant tissues with a biolistic device that accelerates the microprojectiles to speeds sufficient to penetrate plant cell walls and membranes. Sanford et al., *Part. Sci. Technol.* 5:27 (1987), Sanford, J. C., *Trends Biotech.* 6:299 (1988), Sanford, J. C., *Physiol. Plant* 79:206 (1990), Klein et al., *Biotechnology* 10:268 (1992).

Yet another method for physical delivery of DNA to plants is sonication of target cells. Zhang et al., *Bio/Technology* 9:996 (1991). Also, liposome or spheroplast fusion have been used to introduce expression vectors into plants. Deshayes et al., *EMBO* 1, 4:2731 (1985), Christou et al., *Proc Natl. Acad. Sci. USA* 84:3962 (1987). Direct uptake of DNA into protoplasts using $CaCl_2$ precipitation, polyvinyl alcohol or poly-L-ornithine have also been reported. Hain et al., *Mol. Gen. Genet.* 199:161 (1985) and Draper et al., *Plant Cell Physiol.* 23:451 (1982). Electroporation of protoplasts and whole cells and tissues has also been described. Donn et al., Abstracts of VIIth International Congress on Plant Cell and Tissue Culture IAPTC, A2-38, p. 53 (1990); D'Halluin et al., *Plant Cell* 4:1495-1505 (1992) and Spencer et al., *Plant Mol. Biol.* 24:51-61 (1994). Additionally, silicone carbide whiskers (Kaepler et al., 1990, Plant Cell Reports) and in plant transformation using, for example, a flower dipping methodology (Clough and Bent, *Plant J.* 16:735-743 (1998)) can also be used. The exact plant transformation methodology can vary somewhat depending on the plant species selected and the plant cell type selected for transformation (e.g., seedling derived cell types such as hypocotyls and cotelydons or embryonic tissue).

Following the introduction of the genetic construct into plant cells, plant cells can be grown and upon emergence of differentiating tissue such as shoots and roots, mature plants can be generated. In some embodiments, a plurality of plants can be generated. Methodologies for regenerating plants are known to those of ordinary skill in the art and can be found, for example, in: Plant Cell and Tissue Culture, 1994, Vasil and Thorpe Eds. Kluwer Academic Publishers and in: Plant Cell Culture Protocols (Methods in Molecular Biology 111, 1999 Hall Eds Humana Press).

In some embodiments, a genetically modified plant described herein can be cultured in a fermentation medium or grown in a suitable medium such as soil. In some embodiments, a suitable growth medium for higher plants can include any growth medium for plants, including, but not limited to, soil, sand, any other particulate media that support root growth (e.g., vermiculite, perlite, etc.) or hydroponic culture, as well as suitable light, water and nutritional supplements which optimize the growth of the higher plant.

It will be appreciated by one skilled in the art that use of recombinant DNA technologies can improve control of expression of transfected nucleic acid molecules by manipulating, for example, the number of copies of the nucleic acid molecules within the host cell, the efficiency with which those nucleic acid molecules are transcribed, the efficiency with which the resultant transcripts are translated, and the efficiency of post-translational modifications. Additionally, the promoter sequence might be genetically engineered to improve the level of expression as compared to the native promoter. Recombinant techniques useful for controlling the expression of nucleic acid molecules include, but are not limited to, integration of the nucleic acid molecules into one or more host cell chromosomes, addition of vector stability sequences to plasmids, substitutions or modifications of transcription control signals (e.g., promoters, operators, enhancers), substitutions or modifications of translational control signals (e.g., ribosome binding sites, Shine-Delgarno sequences), modification of nucleic acid molecules to correspond to the codon usage of the host cell, and deletion of sequences that destabilize transcripts.

In some embodiments, a plant can include those plants that are known to produce compounds used as pharmaceutical agents, flavoring agents, nutraceutical agents, functional food ingredients or cosmetically active agents or plants that are genetically engineered to produce these compounds/agents.

All of these embodiments of the invention apply to the discussion of any of the genetically modified organisms and methods of producing and using such organisms as described herein.

Products from Genetically Modified Organisms

In some embodiments, a genetically modified organism of the invention produces one or more polyunsaturated fatty acids including, but not limited to, EPA (C20:5, n-3), DHA (C22:6, n-3), DPA (C22:5, n-6 or n-3), ARA (C20:4, n-6), GLA (C18:3, n-6), ALA (C18:3, n-3), and/or SDA (C18:4, n-3)), and in some embodiments, one or more longer-chain PUFAs, including, but not limited to, EPA (C20:5, n-3), DHA (C22:6, n-3), DPA (C22:5, n-6 or n-3), or DTA (C22:4, n-6), or any combination thereof. In some embodiments, a genetically modified plant of the invention produces one or more polyunsaturated fatty acids including, but not limited to, EPA (C20:5, n-3), DHA (C22:6, n-3), and/or DPA (C22:5, n-6 or n-3), or any combination thereof.

In some embodiments, a genetically modified organism is a plant that has been genetically modified to recombinantly express a PUFA synthase system and a PPTase, as described herein. In some embodiments, such a plant has been genetically modified further to express an accessory protein as described herein for the improvement of the production and/or accumulation of PUFAs (or other bioactive products of the PUFA synthase) by the host (e.g., ACoAS, GPAT, LPAAT, DAGAT or ACCase).

Some embodiments of the present invention include the production of polyunsaturated fatty acids of desired chain length and with desired numbers of double bonds and, by extension, oil seed and oils obtained from the genetically modified plants described herein (e.g., obtained from the oil or seeds of such plants) comprising these PUFAs. Examples of PUFAs that can be produced by the present invention include, but are not limited to, DHA (docosahexaenoic acid (C22:6, n-3)), ARA (eicosatetraenoic acid or arachidonic acid (C20:4, n-6)), DPA (docosapentaenoic acid (C22:5, n-6 or n-3)), and EPA (eicosapentaenoic acid (C20:5, n-3)), and any combinations thereof. The present invention allows for the production of commercially valuable lipids enriched in one or more desired (target or primary) PUFAs by the present inventors' development of genetically modified plants through the use of a PUFA synthase system that produces PUFAs.

In some embodiments, a given PUFA synthase system derived from a particular organism will produce particular PUFA(s), such that selection of a PUFA synthase system from a particular organism will result in the production of specified target or primary PUFAs. In some embodiments, the ratio of the PUFAs can differ depending on the selection of the particular PUFA synthase system and on how that system responds to the specific conditions in which it is expressed. For example, use of a PUFA synthase from *Thraustochytrium* 23B (ATCC No. 20892) can also result in the production of DHA and DPAn-6 as the target or primary PUFAs; however, in the case of *Thraustochytrium* 23B, the ratio of DHA to DPAn-6 is about 10:1 (and can range from about 8:1 to about 40:1), whereas in *Schizochytrium*, the ratio is typically about 2.5:1. In some embodiments, a given PUFA synthase can be modified by intermixing proteins and domains from different PUFA synthases, or one can modify a domain or protein of a given PUFA synthase to change the target PUFA product and/or ratios.

In some embodiments, reference to "intermediate products" or "side products" of an enzyme system that produces PUFAs refers to any products, and particularly, fatty acid products, that are produced by the enzyme system as a result of the production of the target or primary PUFA(s) of the system, but which are not the primary or target PUFA(s). In some embodiments, intermediate and side products can include non-target fatty acids that are naturally produced by the wild-type plant, or by the parent plant used as a recipient for the indicated genetic modification, but are now classified as intermediate or side products because they are produced in greater levels as a result of the genetic modification, as compared to the levels produced by the wild-type plant, or by the parent plant used as a recipient for the indicated genetic modification. In some embodiments, a primary or target PUFA of one enzyme system can be an intermediate of a different enzyme system where the primary or target product is a different PUFA. For example, when using the standard pathway to produce EPA, fatty acids such as GLA, DGLA and SDA are produced as intermediate products if significant quantities (e.g., U.S. Appl. Pub. No. 2004/0172682). Similarly, and also illustrated by U.S. Appl. Pub. No. 2004/0172682, when using the standard pathway to produce DHA, in addition to the fatty acids mentioned above, ETA and EPA (notably the target PUFA in the first example above) can be produced in significant quantities and can be present in significantly greater quantities relative to the total fatty acid product than the target PUFA itself.

In some embodiments, to produce significantly high yields of one or more desired polyunsaturated fatty acids, a plant can be genetically modified to introduce a PUFA synthase system into the plant. Plants are not known to endogenously contain a PUFA synthase, and therefore, the present invention represents an opportunity to produce plants with unique fatty acid production capabilities. The present invention provides genetically engineered plants to produce one or more PUFAs in the same plant, including, but not limited to, EPA, DHA, DPA (n3 or n6), ARA, GLA, SDA and others, including any combination thereof. The present invention offers the ability to create any one of a number of "designer oils" in various ratios and forms. In some embodiments, the use of a PUFA synthase system from the particular marine organisms described herein can extend the range of PUFA production and successfully produce such PUFAs within temperature ranges used to grow most crop plants.

In some embodiments, to be "substantially free" of intermediate or side products of the system for synthesizing PUFAs, or to not have intermediate or side products present in substantial amounts, means that any intermediate or side product fatty acids (non-target PUFAs) that are produced in the genetically modified plant (and/or parts of plants and/or seed oil fraction) as a result of the introduction or presence of the enzyme system for producing PUFAs (e.g., that are not produced by the wild-type plant or the parent plant used as a recipient for the indicated genetic modification), can be present in a quantity that is less than about 10% by weight of the total fatty acids produced by the plant, and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% by weight of the total fatty acids produced by the plant, and more preferably less than about 0.5% by weight of the total fatty acids produced by the plant.

In some embodiments, a genetically modified plant of the invention or an oil or seed obtained from a genetically modified plant of the invention comprises detectable amounts of DHA (docosahexaenoic acid (C22:6, n-3)) or EPA (eicosapentaenoic acid (C20:5, n-3)). In some embodiments, a genetically modified plant of the invention or an oil or seed obtained from a genetically modified plant of the invention comprises 0.01%, 0.02%, 0.03%, 0.04%, 0.05%, 0.06%, 0.07%, 0.08%, 0.09%, 0.1%, 0.2%, 0.3%, 0.4%, 0.5%, 0.6%, 0.7%, 0.8%, 0.9%, 1%, 1.5%, 2%, 2.5%, 3%, 3.5%, 4%, 4.5%, 5%, 5.5%, 6%, 6.5%, 7%, 7.5%, 8%, 8.5%, 9%, 9.5%, 10%, 10.5%, 11%, 11.5%, 12%, 12.5%, 13%, 13.5%, 14%, 14.5% or 15% DHA. Useful ranges can be selected between any of these values, for example, 0.01-15%, 0.05-10% and 1-5% DHA.

In some embodiments, a genetically modified plant or the invention or an oil or seed obtained from a genetically modified plant of the invention comprises 0.01%, 0.02%, 0.03%, 0.04%, 0.05%, 0.06%, 0.07%, 0.08%, 0.09%, 0.1%, 0.2%, 0.3%, 0.4%, 0.5%, 0.6%, 0.7%, 0.8%, 0.9%, 1%, 1.5%, 2%, 2.5%, 3%, 3.5%, 4%, 4.5%, 5%, 5.5%, 6%, 6.5%, 7%, 7.5%, 8%, 8.5%, 9%, 9.5%, or 10% EPA. Useful ranges can be selected between any of these values, for example, 0.01-10%, 0.05-5% and 0.1-5% EPA.

In some embodiments, when the target product of a PUFA synthase system is a long chain PUFA, such as DHA, DPA (n-6 or n-3), or EPA, intermediate products and side products that are not present in substantial amounts in the total lipids of plants genetically modified with such a PUFA synthase system can include, but are not limited to: gamma-linolenic acid (GLA; 18:3, n-6); stearidonic acid (STA or SDA; 18:4, n-3); dihomo-gamma-linolenic acid (DGLA or HGLA; 20:3, n-6), arachidonic acid (ARA, C20:4, n-6); eicosatrienoic acid (ETA; 20:3, n-9) and various other intermediate or side products, such as 20:0; 20:1 ($\Delta 5$); 20:1 ($\Delta 11$); 20:2 ($\Delta 8,11$); 20:2 ($\Delta 11,14$); 20:3 ($\Delta 5,11,14$); 20:3 ($\Delta 11,14,17$); mead acid (20:3; $\Delta 5,8,11$); or 20:4 ($\Delta 5,1,14,17$).

The genetic modification of a plant according to the present invention can result in the production of one or more PUFAs by the plant. In some embodiments, the PUFA profile and the ratio of the PUFAs produced by the plant are not necessarily the same as the PUFA profile or ratio of PUFAs produced by the organism from which the PUFA synthase was derived.

In some embodiments, a genetically modified plant of the present invention can be engineered to produce PUFAs through the activity of the PUFA synthase. In some embodiments, the PUFAs can be recovered through purification processes which extract the compounds from the plant. In some embodiments, the PUFAs can be recovered by harvesting the plant. In some embodiments, the PUFAs can be recovered by harvesting the oil from the plant (e.g., from the oil seeds) or seeds from the plant. In some embodiments, the plant can also be consumed in its natural state or further processed into consumable products.

In some embodiments, a genetically modified plant of the invention can produce one or more polyunsaturated fatty acids. In some embodiments, the plant can produce (e.g., in its mature seeds, if an oil seed plant, or in the oil of the seeds of an oil seed plant) at least one PUFA (the target PUFA), and wherein the total fatty acid profile in the plant, or the part of the plant that accumulates PUFAs (e.g., mature seeds, if the plant is an oil seed plant or the oil of the seeds of an oil seed plant), comprises a detectable amount of this PUFA or PUFAs. In some embodiments, the target PUFA is at least a 20 carbon PUFA and comprises at least 3 double bonds, and more preferably at least 4 double bonds, and even more preferably, at least 5 double bonds. In some embodiments, the target PUFA can be a PUFA that is not naturally produced by the plant. In some embodiments, the total fatty acid profile in the plant or in the part of the plant that accumulates PUFAs (including the seed oil of the plant) comprises at least 0.1% of the target PUFA(s) by weight of the total fatty acids, at least 0.2%, at least 0.3%, at least 0.4%, at least 0.5%, at least 1%, at least 1.5%, at least 2%, at least 2.5%, at least 3%, at least 3.5%, at least 4%, at least 4.5%, at least 5%, at least 5.5%, at least 10%, at least 15%, at least 20%, at least 25%, at least 30%, at least 35%, at least 40%, at least 45%, at least 50%, at least 55%, at least 60%, at least 65%, at least 70%, at least 75%, more than 75% of at least one polyunsaturated fatty acid (the target PUFA or PUFAs) by weight of the total fatty acids produced by the plant, or any percentage from 0.1% to 75%, or greater than 75% (up to 100% or 100%), in 0.1% increments, of the target PUFA(s).

As generally used herein, reference to a percentage amount of PUFA production is by weight of the total fatty acids produced by the organism (plant), unless otherwise stated. In some embodiments, total fatty acids produced by a plant are presented as a weight percent as determined by gas chromatography (GC) analysis of a fatty acid methyl ester (FAME) preparation, although determination of total fatty acids is not limited to this method.

In some embodiments, the total fatty acids in a plant of the invention (and/or parts of plants or seed oil fraction) can contain less than 10% by weight of the total fatty acids produced by the plant, less than 9%, and less than 8%, less than 7%, less than 6%, less than 5%, less than 4%, less than 3%, less than 2%, less than 1% of a fatty acid selected from any one or more of: gamma-linolenic acid (GLA; 18:3, n-6); stearidonic acid (STA or SDA; 18:4, n-3); dihomo-gamma-linolenic acid (DGLA or HGLA; 20:3, n-6), arachidonic acid (ARA, C20:4, n-6); eicosatrienoic acid (ETA; 20:3, n-9) and various other fatty acids, such as 20:0; 20:1 ($\Delta 5$); 20:1 ($\Delta 11$); 20:2 ($\Delta 8,11$); 20:2 ($\Delta 11,14$); 20:3 ($\Delta 5,11,14$); 20:3 ($\Delta 11,14, 17$); mead acid (20:3; $\Delta 5,8,11$); or 20:4 ($\Delta 5,1,14,17$).

The present invention includes any seed produced by the plants described herein, as well as any oil produced by a plant or seed of the present invention. The present invention also includes any products produced using the plants, seed or oils as described herein.

Uses and Products Related to the Genetically Modified Organisms of the Invention The present invention includes a method to produce PUFAs by growing or culturing a genetically modified organism (e.g., a plant) of the present invention described in detail above. In some embodiments, such a method includes, for example, the step of growing in a suitable environment, such as soil, a plant that has a genetic modification as described previously herein and in accordance with the present invention.

The present invention includes a method to produce an oil comprising at least one PUFA, comprising recovering oil from a genetically modified plant of the invention or from a seed of a genetically modified plant of the invention. The present invention includes a method to produce an oil comprising at least one PUFA, comprising growing a genetically modified plant of the invention. The present invention includes a method to produce at least one PUFA in a seed oil comprising recovering an oil from a seed of a genetically modified plant of the invention. The present invention includes a method to produce at least one PUFA in a seed oil comprising growing a genetically modified plant of the invention.

The present invention includes a method to provide a supplement or therapeutic product containing at least one PUFA to an individual, comprising providing to the individual a genetically modified plant of the invention, an oil of the invention, a seed of the invention, a food product of the invention, a functional food of the invention, or a pharmaceutical product of the invention. The present invention also includes a method to produce a genetically modified plant of the invention comprising transforming a plant or plant cell with (i) a nucleic acid sequence encoding an algal PUFA synthase system that produces at least one polyunsaturated fatty acid (PUFA); and (ii) a nucleic acid sequence encoding a phosphopantetheinyl transferase (PPTase) that transfers a phosphopantetheinyl cofactor to an algal PUFA synthase system ACP domain. In some embodiments, the method further comprises transforming the plant or plant cell with (iii) a nucleic acid sequence encoding an acyl-CoA synthetase (ACoAS) that catalyzes the conversion of long chain PUFA free fatty acids (FFA) to acyl-CoA.

In some embodiments, the PUFA of such methods is DHA or EPA.

The present invention further includes any organisms or parts thereof described herein (e.g., plants, parts of the plants (e.g., oil seeds), or preparations or fractions thereof), as well as any oils produced by the organisms described herein. The invention also includes any products produced using the organisms, parts thereof, or oils described herein.

The present invention relates to a method to modify a product containing at least one fatty acid, comprising adding to the product an organism, part thereof, or oil produced by a genetically modified organism according to the invention and as described herein (e.g., a plant that has been genetically modified as described herein). Any products produced by this method or generally containing any organisms, parts thereof, or oils from the organisms described herein are also encompassed by the invention.

In some embodiments, the product is selected from the group consisting of a food, a dietary supplement, a pharmaceutical formulation, a humanized animal milk, an infant formula, a nutraceutical and a functional food. Suitable pharmaceutical formulations include, but are not limited to, an anti-inflammatory formulation, a chemotherapeutic agent, an active excipient, an osteoporosis drug, an antidepressant, an anti-convulsant, an anti-*Helicobacter pylori* drug, a drag for treatment of neurodegenerative disease, a drug for treatment of degenerative liver disease, an antibiotic, and a cholesterol lowering formulation. In some embodiments, the product is used to treat a condition selected from the group consisting of chronic inflammation, acute inflammation, gastrointestinal disorder, cancer, cachexia, cardiac restenosis, neurodegenerative disorder, degenerative disorder of the liver, blood lipid disorder, osteoporosis, osteoarthritis, autoimmune disease, preeclampsia, preterm birth, age related maculopathy, pulmonary disorder, and peroxisomal disorder.

In some embodiments, the product is a food product or functional food product. Suitable food products include, but are not limited to, fine bakery wares, bread and rolls, breakfast cereals, processed and unprocessed cheese, condiments (ketchup, mayonnaise, etc.), dairy products (milk, yogurt), puddings and gelatin desserts, carbonated drinks, teas, powdered beverage mixes, processed fish products, fruit-based drinks, chewing gum, hard confectionery, frozen dairy products, processed meat products, nut and nut-based spreads, pasta, processed poultry products, gravies and sauces, potato chips and other chips or crisps, chocolate and other confectionery, soups and soup mixes, soya based products (e.g., milks, drinks, creams, whiteners), vegetable oil-based spreads, and vegetable-based drinks.

In some embodiments of the invention, the product is a feed or meal composition, or an additive for a feed or meal composition, for an animal. The term animal includes all animals, including human beings. Non-limiting examples of animals are non-ruminants (e.g., pigs, poultry, or fish), and ruminants (e.g., cows, sheep and horses). The term feed or feed composition means any compound, preparation, mixture, or composition suitable for, or intended for intake by an animal.

In some embodiments, the genetically modified plant, seed or oil (e.g., canola) comprises reduced levels of polyunsaturated fatty acids and increased levels of monounsaturated oleic acid relative to conventional oils. Such a plant, seed or oil can exhibit, for example, higher oxidative stability. In some embodiments, the genetically modified plant, seed or oil comprises a high oleic acid oil background (e.g., 70%, 75%, 80%, 85%, 90%, 95%, 96%, 97%, 98% or 99% oleic acid). Such a plant, seed or oil can be, for example, less susceptible to oxidation during storage, frying and/or refining, and/or can be heated to a higher temperature without smoking, making it more suitable as a cooking oil. In some embodiments, the genetically modified plant, seed or oil comprises an amount of DHA as described herein and a high oleic oil background (e.g., an amount greater than or equal to 70%, including 70%, 75%, 80%, 85%, 90%, 95%, 96%, 97%, 98%, and 99% oleic acid and any ranges thereof). In some embodiments, the genetically modified plant, seed or oil comprises an amount of DHA as described herein and a low linolenic acid background (e.g., an amount less than or equal to 10%, including 9.5%, 9%, 8.5%, 8%, 7.5%, 7%, 6.5%, 6%, 5.5%, 5%, 4.5%, 4%, 3.5%, 3%, 2.5%, 2%, 1.5%, 1%, 0.05%, 0.02%, or 0.01% linolenic acid and any ranges thereof). In some embodiments, the genetically modified plant, seed or oil comprises an amount of DHA as described herein, a high oleic oil background (e.g., present in an amount greater than or equal to 70%, including 70%, 75%, 80%, 85%, 90%, 95%, 96%, 97%, 98%, and 99% oleic acid and any ranges thereof), and a low linolenic acid background (e.g., an amount less than or equal to 10%, including 9.5%, 9%, 8.5%, 8%, 7.5%, 7%, 6.5%, 6%, 5.5%, 5%, 4.5%, 4%, 3.5%, 3%, 2.5%, 2%, 1.5%, 1%, 0.05%, 0.02%, or 0.01% linolenic acid and any ranges thereof). In some embodiments, such a genetically modified plant, seed or oil (e.g., canola) can be incorporated into a product described herein.

Additional objects, advantages, and novel features of this invention will become apparent to those skilled in the art upon examination of the following examples thereof, which are not intended to be limiting.

EXAMPLES

Example 1

Codon Optimization of PUFA Synthase OrfA, PUFA Synthase OrfB, PUFA Synthase OrfC, Acyl-CoA Synthetase and 4' Phosphopantetheinyl Transferase HetI Analysis of the DNA sequences encoding PUFA OrfA from *Schizochytrium* sp. ATCC_20888 (GenBank ID:

AF378327, GI:158518688), PUFA OrfB from *Schizochytrium* sp. ATCC 20888 (GenBank ID: AF378328, GI:158518690), chimeric PUFA OrfC from *Schizochytrium* sp. ATCC_20888 and *Thraustochytrium* (U.S. Appl. Pub, No. 2008/0022422) ("chimeric OrfC" or "hybrid OrfC"), acyl-CoA synthetase from *Schizochytrium* sp. ATCC_20888 (U.S. Appl. Pub. No. 2007/0245431), and 4' phosphopantetheinyl transferase HetI from *Nostoc* sp. PCC 7120 (GenBank ID: P37695, GI:20141367) coding regions revealed the presence of several sequence motifs containing non-optimal codon compositions that can be detrimental to optimal plant expression. The design of the gene(s) encoding PUFA synthase OrfA, PUFA synthase OrfB, PUFA synthase chimeric OrfC, acyl-CoA synthetase and 4' phosphopantetheinyl transferase HetI proteins was optimized to generate a DNA sequence that is more "plant-like" in nature, and in which the sequence modifications do not hinder translation or create mRNA instability through non-optimal codon composition.

or C in the third position. Further, it is thought that the presence of "minor" codons within an mRNA can reduce the absolute translation rate of that mRNA, especially when the relative abundance of the charged tRNA corresponding to the minor codon is low. An extension of this reasoning is that the diminution of translation rate by individual minor codons would be at least additive for multiple minor codons. Therefore, mRNAs having high relative contents of minor codons would have correspondingly low translation rates. This rate would be reflected by correspondingly low levels of the encoded protein.

In engineering genes encoding a PUFA synthase OrfA, PUFA synthase OrfB, PUFA synthase chimeric OrfC, acyl-CoA synthetase and 4' phosphopantetheinyl transferase HetI protein for expression in canola (or other plants, such as rice, tobacco, maize, cotton or soybean), the codon usages for canola were accessed by publicly available databases (Table 2).

TABLE 2

Synonymous codon representation in coding regions of *Brassica napus* (canola) genes (Columns C and G). Values for a balanced-biased codon representation set for a plant-optimized synthetic gene design are in Columns D and H.

| A<br>Amino<br>Acid | B<br>Codon | C<br>Canola % | D<br>Weighted<br>Average | E<br>Amino<br>Acid | F<br>Codon | G<br>Canola % | H<br>Weighted<br>Average |
|---|---|---|---|---|---|---|---|
| ALA (A) | GCA | 23.3 | 23.3 | LEU (L) | CTA | 10.1 | DNU |
|  | GCC | 21.2 | 21.2 |  | CTC | 22.8 | 28.5 |
|  | GCG | 14.2 | 14.2 |  | CTG | 11.6 | 14.6 |
|  | GCT | 41.3 | 41.3 |  | CTT | 25.2 | 31.6 |
| ARG (R) | AGA | 31.8 | 43.8 |  | TTA | 10.1 | DNU |
|  | AGG | 22.1 | 30.5 |  | TTG | 20.2 | 25.3 |
|  | CGA | 9.9 | DNU | LYS (K) | AAA | 44.6 | 44.6 |
|  | CGC | 8.9 | DNU |  | AAG | 55.4 | 55.4 |
|  | CGG | 8.6 | DNU | MET (M) | ATG | 100.0 | 100.0 |
|  | CGT | 18.6 | 25.7 | PHE (F) | TTC | 58.6 | 58.6 |
| ASN (N) | AAC | 62.6 | 62.6 |  | TTT | 41.4 | 41.4 |
|  | AAT | 37.4 | 37.4 | PRO (P) | CCA | 29.6 | 29.6 |
| ASP (D) | GAC | 42.5 | 42.5 |  | CCC | 14.6 | 14.6 |
|  | GAT | 57.5 | 57.5 |  | CCG | 18.4 | 18.4 |
| CYS (C) | TGC | 49.2 | 49.2 |  | CCT | 37.3 | 37.3 |
|  | TGT | 50.8 | 50.8 | SER (S) | AGC | 16.0 | 17.9 |
| END | TAA | 38.5 | DNU |  | AGT | 14.1 | 15.8 |
|  | TAG | 22.1 | DNU |  | TCA | 18.2 | 20.4 |
|  | TGA | 39.4 | 100.0 |  | TCC | 16.7 | 18.7 |
| GLN (Q) | CAA | 50.0 | 50.0 |  | TCG | 10.7 | DNU |
|  | CAG | 50.0 | 50.0 |  | TCT | 24.3 | 27.2 |
| GLU (E) | GAA | 43.6 | 43.6 | THR (T) | ACA | 26.3 | 26.3 |
|  | GAG | 56.4 | 56.4 |  | ACC | 26.9 | 26.9 |
| GLY (G) | GGA | 36.4 | 36.4 |  | ACG | 16.9 | 16.9 |
|  | GGC | 16.2 | 16.2 |  | ACT | 30.0 | 30.0 |
|  | GGG | 15.2 | 15.2 | TRP (W) | TGG | 100.0 | 100.0 |
|  | GGT | 32.1 | 32.1 | TYR (Y) | TAC | 59.4 | 59.4 |
| HIS (H) | CAC | 49.6 | 49.6 |  | TAT | 40.6 | 40.6 |
|  | CAT | 50.4 | 50.4 | VAL (V) | GTA | 10.8 | DNU |
| ILE (I) | ATA | 21.1 | 21.1 |  | GTC | 24.1 | 27.0 |
|  | ATC | 42.7 | 42.7 |  | GTG | 28.3 | 31.7 |
|  | ATT | 36.2 | 36.2 |  | GTT | 36.8 | 41.3 |

*DNU = Do Not Use

Due to the plasticity afforded by the redundancy/degeneracy of the genetic code (e.g., some amino acids are specified by more than one codon), evolution of the genomes in different organisms or classes of organisms has resulted in differential usage of synonymous codons. This "codon bias" is reflected in the mean base composition of protein coding regions. For example, organisms having genomes with relatively low G+C contents utilize more codons having A or T in the third position of synonymous codons, whereas those having higher G+C contents utilize more codons having G To balance the distribution of the remaining codon choices for an amino acid, a Weighted Average representation for each codon was calculated (Table 2), using the formula:

Weighted Average % of C1=1/(% C1+% C2+% C3+etc.)×% C1×100, where C1 is the codon in question and % C2, % C3, etc. represent the averages of the % values for canola of remaining synonymous codons (average % values for the relevant codons are taken from Columns C and G) of Table 2.

The Weighted Average % value for each codon is given in Columns D and H of Table 2.

In designing coding regions for plant expression, the primary ("first choice") codons preferred by the plant was determined, as well as the second, third, fourth etc. choices of preferred codons when multiple choices exist. A new DNA sequence was then designed which encoded essentially the same amino acid sequence of an PUFA synthase OrfA, PUFA synthase OrfB, PUFA synthase OrfC, acyl-CoA synthetase and 4' phosphopantetheinyl transferase HetI, but which differed from the original DNA sequence (encoding the PUFA synthase OrfA, PUFA synthase OrfB, PUFA synthase chimeric OrfC, acyl-CoA synthetase and 4' phosphopantetheinyl transferase HetI) by the substitution of plant (first preferred, second preferred, third preferred, or fourth preferred, etc.) codons to specify the amino acid at each position within the amino acid sequence.

The new sequences were then analyzed for restriction enzyme sites created by the modifications in the sequence. The identified sites were then modified by replacing the codons with first, second, third, or fourth choice preferred codons. The sequence was then further analyzed and modified to reduce the frequency of TA or GC doublets.

Analysis of these sequences revealed that the new DNA sequences encoded essentially the amino acid sequence of the PUFA synthase OrfA, PUFA synthase OrfB, PUFA synthase chimeric OrfC, acyl-CoA synthetase and 4' phosphopantetheinyl transferase HetI proteins but were respectively designed for optimal expression in canola using a balanced codon distribution of frequently used codons found in canola genes. In particular, the new DNA sequences differed from the original DNA sequences encoding an PUFA synthase OrfA, PUFA synthase OrfB, PUFA synthase chimeric OrfC, acyl-CoA synthetase and 4' phosphopantetheinyl transferase HetI by the substitution of plant (first preferred, second preferred, third preferred, or fourth preferred) codons to specify the appropriate amino acid at each position within the protein amino acid sequence.

Design of the plant-optimized DNA sequences were initiated by reverse-translation of the protein sequences of SEQ ID NO:1, SEQ ID NO:2, SEQ ID NO:3, SEQ ID NO:4 and SEQ ID NO:5 using a canola codon bias table constructed from Table 2, Columns D and H. The protein sequence for acyl-CoA synthetase (SEQ ID NO:4) was altered from the original sequence; wherein the second amino acid Alanine was removed from the protein. The initial sequences were then modified by compensating codon changes (while retaining overall weighted average codon representation) to remove or add restriction enzyme recognition sites, remove highly stable intrastrand secondary structures, and remove other sequences that might be detrimental to cloning manipulations or expression of the engineered gene in plants. The DNA sequences were then re-analyzed for restriction enzyme recognition sites that might have been created by the modifications. The identified sites were further modified by replacing the relevant codons with first, second, third, or fourth choice preferred codons. Other sites in the sequences that could affect transcription or translation of the gene of interest include the exon:intron junctions (5' or 3'), poly A addition signals, or RNA polymerase termination signals. The modified sequences were further analyzed and further modified to reduce the frequency of TA or CG doublets, and to increase the frequency of TG or CT doublets. In addition to these doublets, sequence blocks that have more than about six consecutive residues of [G+C] or [A+T] can affect transcription or translation of the sequence. Therefore, these sequence blocks were also modified by replacing the codons of first or second choice, etc. with other preferred codons of choice. Rarely used codons are not included to a substantial extent in the gene design, being used only when necessary to accommodate a different design criterion than codon composition per se (e.g., addition or deletion of restriction enzyme recognition sites).

The protein encoded by PUFA synthase OrfA comprises 10 repeated "Proline-Alanine" domains ranging in size from 17 to 29 amino acids. Interspersed between the Proline-Alanine repeats were 9 longer repeated sequence domains comprising 87 amino acids. The amino acid sequences of these repeats vary at only 4 positions, and there were only two amino acid choices at each of the variant positions. Analyses of the amino acid sequences of the 9 repeats using the Clustal W computer program generated a homology value of 100%, and an identity value of 95.4%. At the DNA level, the sequences encoding the 9 repeats are 100% homologous, 89.7% identical, varying at only 27 positions in the 261 bases encoding each repeat (23 of the 27 changes are "silent" differences, in which synonymous codons for the same amino acid are interchanged).

Standard gene design processes cannot easily accommodate developing new codon biased DNA sequences for multiple repeats of this size, since one must continually balance all the codon choices in an individual repeat with the codon choices made at the same position in the other 8 repeats, to avoid generating highly related DNA sequences. For each of the 87 residue repeats, there were more than $4.5 \times 10^{43}$ possible DNA sequences to encode the same amino acid sequence (calculated as the product of the number of synonymous codons for each amino acid in the sequence). Thus, there was a very large computing space available to generate identically-encoding DNA sequences. The following protocol describes a method used to generate (in silico) multiple sequence designs for each individual repeat, followed by comparison of all the sequence versions in bulk to identify a set that represents highly diverged sequences encoding the repeats:

Step 1: Extract the native DNA sequence encoding each repeated amino acid domain as a separate sequence.

Step 2: Import the individual repeated DNA sequences as separate sequences into a gene design program (e.g., OPTGENE™, Ocimum Biosolutions, Hyderabad, India). Steps 3-5 are performed on each sequence separately.

Step 3: Translate the DNA sequence using the standard genetic code.

Step 4: Reverse translate the translated protein sequence using the standard genetic code and the appropriate codon bias table. In this example, a biased codon table compiled from 530 *Brassica napus* protein coding regions was used, and each generated sequence was code-named "nap" (for "napus") plus the version number. Thus, the first reverse-translated, codon biased sequence for Repeat 1 was named "rpt1 nap1." In this illustration, this process was performed 10 times, to generate 10 DNA sequence versions encoding the protein sequence of Repeat 1.

Step 5: Export the 10 sequence versions into the corresponding number of text files.

Step 6: Repeat Steps 3-5 for each of the other repeated sequence domains. In this illustration, a total of 90 "nap" sequence versions were generated (10 for each repeated element).

Step 7: Import the 90 sequence files into the Clustal W program Mega 3.1 (accessed at Megasoftware) and perform a multiple sequence alignment using all 90 sequences as input. Because these sequences are segments of protein coding regions, the alignments are performed with no gaps allowed. After Clustal W Alignment, a Neighbor-Joining tree is assembled and visualized, and one of the ten codon-optimized sequences for each of the nine repeated domains in the protein is picked visually. Each selected sequence version is chosen from a section of the tree that is the most deeply branched.

Step 8: The chosen sequence for each repeated domain is incorporated into the codon-optimized DNA sequence encoding the entire protein, in the proper position for each particular repeat.

Step 9: Final analyses of the entire codon optimized sequence, including the separately designed diverged repeat elements, are performed to assure the absence of undesired motifs, restriction enzyme recognition sites, etc.

The newly designed, canola optimized PUFA synthase OrfA, PUFA synthase OrfB, PUFA synthase OrfC, acyl-CoA synthetase and 4' phosphopantetheinyl transferase HetI DNA sequences are listed, respectively, in SEQ ID NO:6, SEQ ID NO:7, SEQ ID NO:8, SEQ ID NO:9 and SEQ ID NO:10. These codon optimized sequences are identified as version 3 (v3) throughout the specification. The sequences labeled as version 2 (v2) describe the original noncodon optimized sequences.

The resulting DNA sequences have a higher degree of codon diversity, a desirable base composition, contain strategically placed restriction enzyme recognition sites, and lacks sequences that might interfere with transcription of the gene, or translation of the product mRNA. Table 3, Table 4, Table 5, Table 6 and Table 7 present the comparisons of the codon compositions of the coding regions for the PUFA synthase OrfA, PUFA synthase OrfB, PUFA synthase chimeric OrfC, acyl-CoA synthetase and 4' phosphopantetheinyl transferase HetI proteins found in the original gene, the plant-optimized versions and the codon composition recommendations for a plant optimized sequence as calculated from Table 2, Columns D and H.

TABLE 3

PUFA OrfA codon compositions

| Amino Acid | Codon | Original Gene # | Original Gene % | Plnt Opt Gene # | Plnt Opt Gene % | Plnt Opt Recm'd | Amino Acid | Codon | Original Gene # | Original Gene % | Plnt Opt Gene # | Plnt Opt Gene % | Plnt Opt Recm'd |
|---|---|---|---|---|---|---|---|---|---|---|---|---|---|
| ALA (A) | GCA | 7 | 1.5 | 109 | 23.3 | 23.3 | LEU (L) | CTA | 0 | 0.0 | 0 | 0.0 | 0.0 |
|  | GCC | 302 | 64.5 | 99 | 21.2 | 21.2 |  | CTC | 173 | 77.9 | 63 | 28.4 | 28.5 |
|  | GCG | 49 | 10.5 | 67 | 14.3 | 14.2 |  | CTG | 15 | 6.8 | 32 | 14.4 | 14.6 |
|  | GCT | 110 | 23.5 | 193 | 41.2 | 41.3 |  | CTT | 33 | 14.9 | 71 | 32.0 | 31.6 |
| ARG (R) | AGA | 0 | 0.0 | 57 | 43.5 | 43.8 |  | TTA | 0 | 0.0 | 0 | 0.0 | 0.0 |
|  | AGG | 0 | 0.0 | 40 | 30.5 | 30.5 |  | TTG | 1 | 0.5 | 56 | 25.2 | 25.3 |
|  | CGA | 0 | 0.0 | 0 | 0.0 | 0.0 | LYS (K) | AAA | 2 | 1.2 | 73 | 44.5 | 44.6 |
|  | CGC | 112 | 85.5 | 0 | 0.0 | 0.0 |  | AAG | 162 | 98.8 | 91 | 55.5 | 55.4 |
|  | CGG | 1 | 0.8 | 0 | 0.0 | 0.0 | MET (M) | ATG | 88 | 100 | 88 | 100 | 100.0 |
|  | CGT | 18 | 13.7 | 34 | 26.0 | 25.7 | PHE (F) | TTC | 50 | 69.4 | 42 | 58.3 | 58.6 |
| ASN (N) | AAC | 73 | 97.3 | 47 | 62.7 | 62.6 |  | TTT | 22 | 30.6 | 30 | 41.7 | 41.4 |
|  | AAT | 2 | 2.7 | 28 | 37.3 | 37.4 | PRO (P) | CCA | 2 | 1.3 | 45 | 30.0 | 29.6 |
| ASP (D) | GAC | 126 | 76.8 | 70 | 42.7 | 42.5 |  | CCC | 56 | 37.3 | 22 | 14.7 | 14.6 |
|  | GAT | 38 | 23.2 | 94 | 57.3 | 57.5 |  | CCG | 46 | 30.7 | 27 | 18.0 | 18.4 |
| CYS (C) | TGC | 34 | 94.4 | 18 | 50.0 | 49.2 |  | CCT | 46 | 30.7 | 56 | 37.3 | 37.3 |
|  | TGT | 2 | 5.6 | 18 | 50.0 | 50.8 | SER (S) | AGC | 40 | 21.3 | 34 | 18.1 | 17.9 |
| END | TAA | 1 | 100.0 | 0 | 0.0 | 0.0 |  | AGT | 1 | 0.5 | 30 | 16.0 | 15.8 |
|  | TAG | 0 | 0.0 | 0 | 0.0 | 0.0 |  | TCA | 0 | 0.0 | 38 | 20.2 | 20.4 |
|  | TGA | 0 | 0.0 | 1 | 100.0 | 100.0 |  | TCC | 70 | 37.2 | 35 | 18.6 | 18.7 |
| GLN (Q) | CAA | 4 | 4.4 | 46 | 50.5 | 50.0 |  | TCG | 59 | 31.4 | 6 | 0.0 | 0.0 |
|  | CAG | 87 | 95.6 | 45 | 49.5 | 50.0 |  | TCT | 18 | 9.6 | 51 | 27.1 | 27.2 |
| GLU (E) | GAA | 9 | 3.8 | 103 | 43.6 | 43.6 | THR (T) | ACA | 2 | 1.3 | 41 | 26.3 | 26.3 |
|  | GAG | 227 | 96.2 | 133 | 56.4 | 56.4 |  | ACC | 81 | 51.9 | 42 | 26.9 | 26.9 |
| GLY (G) | GGA | 6 | 3.1 | 71 | 36.2 | 36.4 |  | ACG | 26 | 16.7 | 26 | 16.7 | 16.9 |
|  | GGC | 156 | 79.6 | 32 | 16.3 | 16.2 |  | ACT | 47 | 30.1 | 47 | 30.1 | 30.0 |
|  | GGG | 0 | 0.0 | 30 | 15.3 | 15.2 | TRP (W) | TGG | 13 | 100 | 13 | 100 | 100.0 |
|  | GGT | 34 | 17.3 | 63 | 32.1 | 32.1 | TYR (Y) | TAC | 42 | 97.7 | 26 | 60.5 | 59.4 |
| HIS (H) | CAC | 25 | 83.3 | 15 | 50.0 | 49.6 |  | TAT | 1 | 2.3 | 17 | 39.5 | 40.6 |
|  | CAT | 5 | 16.7 | 15 | 50.0 | 50.4 | VAL (V) | GTA | 0 | 0.0 | 0 | 0.0 | 0.0 |
| ILE (I) | ATA | 0 | 0.0 | 29 | 21.0 | 21.1 |  | GTC | 176 | 70.7 | 67 | 26.9 | 27.0 |
|  | ATC | 99 | 71.7 | 59 | 42.8 | 42.7 |  | GTG | 39 | 15.7 | 79 | 31.7 | 31.7 |
|  | ATT | 39 | 28.3 | 50 | 36.2 | 36.2 |  | GTT | 34 | 13.7 | 103 | 41.4 | 41.3 |
|  | Totals | 1566 |  | 1566 |  |  |  | Totals | 1345 |  | 1345 |  |  |

TABLE 4

PUFA OrfB codon compositions

| Amino Acid | Codon | Original Gene # | Original Gene % | Plnt Opt Gene # | Plnt Opt Gene % | Plnt Opt Recm'd | Amino Acid | Codon | Original Gene # | Original Gene % | Plnt Opt Gene # | Plnt Opt Gene % | Plnt Opt Recm'd |
|---|---|---|---|---|---|---|---|---|---|---|---|---|---|
| ALA (A) | GCA | 13 | 5.7 | 53 | 23.2 | 23.3 | LEU (L) | CTA | 0 | 0.0 | 0 | 0.0 | 0.0 |
|  | GCC | 135 | 59.2 | 48 | 21.1 | 21.2 |  | CTC | 116 | 63.0 | 51 | 27.7 | 28.5 |
|  | GCG | 43 | 18.9 | 34 | 14.9 | 14.2 |  | CTG | 21 | 11.4 | 27 | 14.7 | 14.6 |
|  | GCT | 37 | 16.2 | 93 | 40.8 | 41.3 |  | CTT | 44 | 23.9 | 59 | 32.1 | 31.6 |
| ARG (R) | AGA | 0 | 0.0 | 54 | 45.0 | 43.8 |  | TTA | 0 | 0.0 | 0 | 0.0 | 0.0 |
|  | AGG | 0 | 0.0 | 36 | 30.0 | 30.5 |  | TTG | 3 | 1.6 | 47 | 25.5 | 25.3 |
|  | CGA | 1 | 0.8 | 0 | 0.0 | 0.0 | LYS (K) | AAA | 10 | 8.8 | 52 | 45.6 | 44.6 |
|  | CGC | 95 | 79.2 | 0 | 0.0 | 0.0 |  | AAG | 104 | 91.2 | 62 | 54.4 | 55.4 |
|  | CGG | 1 | 0.8 | 0 | 0.0 | 0.0 | MET (M) | ATG | 45 | 100 | 45 | 100 | 100.0 |
|  | CGT | 23 | 19.2 | 30 | 25.0 | 25.7 | PHE (F) | TTC | 33 | 47.8 | 41 | 59.4 | 58.6 |

TABLE 4-continued

PUFA OrfB codon compositions

| Amino Acid | Codon | Original Gene # | Original Gene % | Plnt Opt Gene # | Plnt Opt Gene % | Plnt Opt Recm'd | Amino Acid | Codon | Original Gene # | Original Gene % | Plnt Opt Gene # | Plnt Opt Gene % | Plnt Opt Recm'd |
|---|---|---|---|---|---|---|---|---|---|---|---|---|---|
| ASN (N) | AAC | 75 | 89.3 | 51 | 60.7 | 62.6 | | TTT | 36 | 52.2 | 28 | 40.6 | 41.4 |
| | AAT | 9 | 10.7 | 33 | 39.3 | 37.4 | PRO (P) | CCA | 8 | 7.2 | 33 | 29.7 | 29.6 |
| ASP (D) | GAC | 86 | 72.3 | 52 | 43.7 | 42.5 | | CCC | 47 | 42.3 | 16 | 14.4 | 14.6 |
| | GAT | 33 | 27.7 | 67 | 56.3 | 57.5 | | CCG | 35 | 31.5 | 20 | 18.0 | 18.4 |
| CYS (C) | TGC | 41 | 100.0 | 20 | 48.8 | 49.2 | | CCT | 21 | 18.9 | 42 | 37.8 | 37.3 |
| | TGT | 0 | 0.0 | 21 | 51.2 | 50.8 | SER (S) | AGC | 40 | 26.5 | 28 | 18.5 | 17.9 |
| END | TAA | 1 | 100.0 | 0 | 0.0 | 0.0 | | AGT | 7 | 4.6 | 24 | 15.9 | 15.8 |
| | TAG | 0 | 0.0 | 0 | 0.0 | 0.0 | | TCA | 2 | 1.3 | 31 | 20.5 | 20.4 |
| | TGA | 0 | 0.0 | 1 | 100.0 | 100.0 | | TCC | 55 | 36.4 | 28 | 18.5 | 18.7 |
| GLN (Q) | CAA | 8 | 13.6 | 30 | 50.8 | 50.0 | | TCG | 33 | 21.9 | 0 | 0.0 | 0.0 |
| | CAG | 51 | 86.4 | 29 | 49.2 | 50.0 | | TCT | 14 | 9.3 | 40 | 26.5 | 27.2 |
| GLU (E) 16 | GAA | 33 | 24.8 | 58 | 43.6 | 43.6 | THR (T) | ACA | 8 | 8.1 | 28 | 28.3 | 26.3 |
| | GAG | 100 | 75.2 | 75 | 56.4 | 56.4 | | ACC | 58 | 58.6 | 24 | 24.2 | 26.9 |
| GLY (G) | GGA | 11 | 7.2 | 55 | 36.2 | 36.4 | | ACG | 26 | 26.3 | 16 | 16.2 | 16.9 |
| | GGC | 102 | 67.1 | 25 | 16.4 | 16.2 | | ACT | 7 | 7.1 | 31 | 31.3 | 30.0 |
| | GGG | 3 | 2.0 | 23 | 15.1 | 15.2 | TRP (W) | TGG | 22 | 100 | 22 | 100 | 100.0 |
| | GGT | 36 | 23.7 | 49 | 32.2 | 32.1 | TYR (Y) | TAC | 51 | 91.1 | 32 | 57.1 | 59.4 |
| HIS (H) | CAC | 29 | 76.3 | 19 | 50.0 | 49.6 | | TAT | 5 | 8.9 | 24 | 42.9 | 40.6 |
| | CAT | 9 | 23.7 | 19 | 50.0 | 50.4 | VAL (V) | GTA | 1 | 0.8 | 0 | 6.0 | 0.0 |
| ILE (I) | ATA | 0 | 0.0 | 22 | 21.2 | 21.1 | | GTC | 85 | 65.4 | 34 | 26.2 | 27.0 |
| | ATC | 67 | 64.4 | 44 | 42.3 | 42.7 | | GTG | 30 | 23.1 | 42 | 32.3 | 31.7 |
| | ATT | 37 | 35.6 | 38 | 36.5 | 36.2 | | GTT | 14 | 10.8 | 54 | 41.5 | 41.3 |
| | Totals | 1079 | | 1079 | | | | Totals | 981 | | 981 | | |

TABLE 5

PUFA chimeric OrfC codon compositions

| Amino Acid | Codon | Original Gene # | Original Gene % | Plnt Opt Gene # | Plnt Opt Gene % | Plnt Ops Recm'd | Amino Acid | Codon | Original Gene # | Original Gene % | Plnt Opt Gene # | Plnt Opt Gene % | Plnt Ops Recm'd |
|---|---|---|---|---|---|---|---|---|---|---|---|---|---|
| ALA (A) | GCA | 18 | 14.0 | 30 | 23.3 | 23.3 | LEU (L) | CTA | 2 | 1.6 | 0 | 0.0 | 0.0 |
| | GCC | 84 | 65.1 | 28 | 21.7 | 21.2 | | CTC | 78 | 63.9 | 34 | 27.9 | 28.5 |
| | GCG | 14 | 10.9 | 19 | 14.7 | 14.2 | | CTG | 18 | 14.8 | 18 | 14.8 | 14.6 |
| | GCT | 13 | 10.1 | 52 | 40.3 | 41.3 | | CTT | 16 | 13.1 | 39 | 32.0 | 31.6 |
| ARG (R) | AGA | 1 | 1.3 | 33 | 44.0 | 43.8 | | TTA | 1 | 0.8 | 0 | 0.0 | 0.0 |
| | AGG | 1 | 1.3 | 23 | 30.7 | 30.5 | | TTG | 7 | 5.7 | 31 | 25.4 | 25.3 |
| | CGA | 6 | 8.0 | 0 | 0.0 | 0.0 | LYS (K) | AAA | 15 | 16.1 | 42 | 45.2 | 44.6 |
| | CGC | 53 | 70.7 | 0 | 0.0 | 0.0 | | AAG | 78 | 83.9 | 51 | 54.8 | 55.4 |
| | CGG | 3 | 4.0 | 0 | 0.0 | 0.0 | MET (M) | ATG | 48 | 100 | 48 | 100 | 100.0 |
| | CGT | 11 | 14.7 | 19 | 25.3 | 25.7 | PHE (F) | TTC | 40 | 58.8 | 40 | 58.8 | 58.6 |
| ASN (N) | AAC | 63 | 90.0 | 43 | 61.4 | 62.6 | | TTT | 28 | 41.2 | 28 | 41.2 | 41.4 |
| | AAT | 7 | 10.0 | 27 | 38.6 | 37.4 | PRO (P) | CCA | 10 | 11.2 | 27 | 30.3 | 29.6 |
| ASP (D) | GAC | 70 | 76.9 | 40 | 44.0 | 42.5 | | CCC | 35 | 39.3 | 13 | 14.6 | 14.6 |
| | GAT | 21 | 23.1 | 51 | 56.0 | 57.5 | | CCG | 26 | 29.2 | 16 | 18.0 | 18.4 |
| CYS (C) | TGC | 26 | 81.3 | 16 | 50.0 | 49.2 | | CCT | 18 | 20.2 | 33 | 37.1 | 37.3 |
| | TGT | 6 | 18.8 | 16 | 50.0 | 50.8 | SER (S) | AGC | 16 | 19.0 | 13 | 15.5 | 17.9 |
| END | TAA | 1 | 100.0 | 0 | 0.0 | 0.0 | | AGT | 3 | 3.6 | 14 | 16.7 | 15.8 |
| | TAG | 0 | 0.0 | 0 | 0.0 | 0.0 | | TCA | 9 | 10.7 | 18 | 21.4 | 20.4 |
| | TGA | 0 | 0.0 | 1 | 100.0 | 100.0 | | TCC | 28 | 33.3 | 16 | 19.0 | 18.7 |
| GLN (Q) | CAA | 11 | 24.4 | 25 | 55.6 | 50.0 | | TCG | 21 | 25.0 | 0 | 0.0 | 0.0 |
| | CAG | 34 | 75.6 | 20 | 44.4 | 50.0 | | TCT | 7 | 8.3 | 23 | 27.4 | 27.2 |
| GLU (E) 16 | GAA | 17 | 19.1 | 40 | 44.9 | 43.6 | THR (T) | ACA | 4 | 6.2 | 17 | 26.2 | 26.3 |
| | GAG | 72 | 80.9 | 49 | 55.1 | 56.4 | | ACC | 41 | 63.1 | 17 | 26.2 | 26.9 |
| GLY (G) | GGA | 21 | 17.9 | 43 | 36.8 | 36.4 | | ACG | 8 | 12.3 | 11 | 16.9 | 16.9 |
| | GGC | 78 | 66.7 | 18 | 15.4 | 16.2 | | ACT | 12 | 18.5 | 20 | 30.8 | 30.0 |
| | GGG | 7 | 6.0 | 18 | 15.4 | 15.2 | TRP (W) | TGG | 18 | 100 | 18 | 100 | 100.0 |
| | GGT | 11 | 9.4 | 38 | 32.5 | 32.1 | TYR (Y) | TAC | 41 | 87.2 | 28 | 59.6 | 59.4 |
| HIS (H) | CAC | 24 | 85.7 | 14 | 50.0 | 49.6 | | TAT | 6 | 12.8 | 19 | 40.4 | 40.6 |
| | CAT | 4 | 14.3 | 14 | 50.0 | 50.4 | VAL (V) | GTA | 6 | 5.3 | 0 | 0.0 | 0.0 |
| ILE (I) | ATA | 0 | 0.0 | 15 | 21.7 | 21.1 | | GTC | 62 | 54.4 | 31 | 27.2 | 27.0 |
| | ATC | 48 | 69.6 | 30 | 43.5 | 42.7 | | GTG | 24 | 21.1 | 37 | 32.5 | 31.7 |
| | ATT | 21 | 30.4 | 24 | 34.8 | 36.2 | | GTT | 22 | 19.3 | 46 | 40.4 | 41.3 |
| | Totals | 746 | | 746 | | | | Totals | 748 | | 748 | | |

TABLE 6

Acyl-CoA synthetase codon compositions

| Amino Acid | Codon | Original Gene # | Original Gene % | Plnt Opt Gene # | Plnt Opt Gene % | Plnt Opt Recm'd | Amino Acid | Codon | Original Gene # | Original Gene % | Plnt Opt Gene # | Plnt Opt Gene % | Plnt Opt Recm'd |
|---|---|---|---|---|---|---|---|---|---|---|---|---|---|
| ALA (A) | GCA | 2 | 2.3 | 21 | 24.7 | 23.3 | LEU (L) | CTA | 0 | 0.0 | 0 | 0.0 | 0.0 |
|  | GCC | 59 | 68.6 | 18 | 21.2 | 21.2 |  | CTC | 35 | 63.6 | 15 | 27.3 | 28.5 |
|  | GCG | 11 | 12.8 | 12 | 14.1 | 14.2 |  | CTG | 6 | 10.9 | 9 | 16.4 | 14.6 |
|  | GCT | 14 | 16.3 | 34 | 40.0 | 41.3 |  | CTT | 13 | 23.6 | 17 | 30.9 | 31.6 |
| ARG (R) | AGA | 0 | 0.0 | 14 | 43.8 | 43.8 |  | TTA | 0 | 0.0 | 0 | 0.0 | 0.0 |
|  | AGG | 3 | 9.4 | 10 | 31.3 | 30.5 |  | TTG | 1 | 1.8 | 14 | 25.5 | 25.3 |
|  | CGA | 0 | 0.0 | 0 | 0.0 | 0.0 | LYS (K) | AAA | 2 | 4.1 | 22 | 44.9 | 44.6 |
|  | CGC | 25 | 78.1 | 0 | 0.0 | 0.0 |  | AAG | 47 | 95.9 | 27 | 55.1 | 55.4 |
|  | CGG | 0 | 0.0 | 0 | 0.0 | 0.0 | MET (M) | ATG | 21 | 100 | 21 | 100 | 100.0 |
|  | CGT | 4 | 12.5 | 8 | 25.0 | 25.7 | PHE (F) | TTC | 16 | 51.6 | 18 | 58.1 | 58.6 |
| ASN (N) | AAC | 22 | 95.7 | 14 | 60.9 | 62.6 |  | TTT | 15 | 48.4 | 13 | 41.9 | 41.4 |
|  | AAT | 1 | 4.3 | 9 | 39.1 | 37.4 | PRO (P) | CCA | 0 | 0.0 | 11 | 30.6 | 29.6 |
| ASP (D) | GAC | 38 | 74.5 | 22 | 43.1 | 42.5 |  | CCC | 20 | 55.6 | 5 | 13.9 | 14.6 |
|  | GAT | 13 | 25.5 | 29 | 56.9 | 57.5 |  | CCG | 9 | 25.0 | 7 | 19.4 | 18.4 |
| CYS (C) | TGC | 11 | 91.7 | 6 | 50.0 | 49.2 |  | CCT | 7 | 19.4 | 13 | 36.1 | 37.3 |
|  | TGT | 1 | 8.3 | 6 | 50.0 | 50.8 | SER (S) | AGC | 7 | 17.5 | 7 | 17.5 | 17.9 |
| END | TAA | 1 | 100.0 | 0 | 0.0 | 0.0 |  | AGT | 4 | 10.0 | 6 | 15.0 | 15.8 |
|  | TAG | 0 | 0.0 | 0 | 0.0 | 0.0 |  | TCA | 1 | 2.5 | 8 | 20.0 | 20.4 |
|  | TGA | 0 | 0.0 | 1 | 100.0 | 100.0 |  | TCC | 19 | 47.5 | 8 | 20.0 | 18.7 |
| GLN (Q) | CAA | 3 | 18.8 | 8 | 50.0 | 50.0 |  | TCG | 7 | 17.5 | 0 | 0.0 | 0.0 |
|  | CAG | 13 | 81.3 | 8 | 50.0 | 50.0 |  | TCT | 2 | 5.0 | 11 | 27.5 | 27.2 |
| GLU (E) | GAA | 11 | 17.7 | 27 | 43.5 | 43.6 | THR (T) | ACA | 1 | 2.0 | 13 | 25.5 | 26.3 |
| 16 | GAG | 51 | 82.3 | 35 | 56.5 | 56.4 |  | ACC | 27 | 52.9 | 14 | 27.5 | 26.9 |
| GLY (G) | GGA | 5 | 7.4 | 25 | 36.8 | 36.4 |  | ACG | 19 | 37.3 | 9 | 17.6 | 16.9 |
|  | GGC | 49 | 72.1 | 11 | 16.2 | 16.2 |  | ACT | 4 | 7.8 | 15 | 29.4 | 30.0 |
|  | GGG | 0 | 0.0 | 10 | 14.7 | 15.2 | TRP (W) | TGG | 10 | 100 | 10 | 100 | 100.0 |
|  | GGT | 14 | 20.6 | 22 | 32.4 | 32.1 | TYR (Y) | TAC | 18 | 85.7 | 12 | 57.1 | 59.4 |
| HIS (H) | CAC | 10 | 83.3 | 6 | 50.0 | 49.6 |  | TAT | 3 | 14.3 | 9 | 42.9 | 40.6 |
|  | CAT | 2 | 16.7 | 6 | 50.0 | 50.4 | VAL (V) | GTA | 0 | 0.0 | 0 | 0.0 | 0.0 |
| ILE (I) | ATA | 0 | 0.0 | 10 | 21.3 | 21.1 |  | GTC | 34 | 58.6 | 16 | 27.6 | 27.0 |
|  | ATC | 27 | 57.4 | 20 | 42.6 | 42.7 |  | GTG | 9 | 15.5 | 19 | 32.8 | 31.7 |
|  | ATT | 20 | 42.6 | 17 | 36.2 | 36.2 |  | GTT | 15 | 25.9 | 23 | 39.7 | 41.3 |
|  | Totals | 410 |  | 409 |  |  |  | Totals | 372 |  | 372 |  |  |

TABLE 7

Phosphopantetheinyl transferase HetI codon compositions

| Amino Acid | Codon | Original Gene # | Original Gene % | Plnt Opt Gene # | Plnt Opt Gene % | Plnt Opt Recm'd | Amino Acid | Codon | Original Gene # | Original Gene % | Plnt Opt Gene # | Plnt Opt Gene % | Plnt Opt Recm'd |
|---|---|---|---|---|---|---|---|---|---|---|---|---|---|
| ALA (A) | GCA | 4 | 20.0 | 5 | 25.0 | 23.3 | LEU (L) | CTA | 6 | 17.1 | 0 | 0.0 | 0.0 |
|  | GCC | 6 | 30.0 | 4 | 20.0 | 21.2 |  | CTC | 4 | 11.4 | 10 | 28.6 | 28.5 |
|  | GCG | 2 | 10.0 | 3 | 15.0 | 14.2 |  | CTG | 0 | 0.0 | 5 | 14.3 | 14.6 |
|  | GCT | 8 | 40.0 | 8 | 40.0 | 41.3 |  | CTT | 3 | 8.6 | 11 | 31.4 | 31.6 |
| ARG (R) | AGA | 1 | 6.3 | 6 | 37.5 | 43.8 |  | TTA | 14 | 40.0 | 0 | 0.0 | 0.0 |
|  | AGG | 1 | 6.3 | 5 | 31.3 | 30.5 |  | TTG | 8 | 22.9 | 9 | 25.7 | 25.3 |
|  | CGA | 2 | 12.5 | 0 | 0.0 | 0.0 | LYS (K) | AAA | 10 | 90.9 | 5 | 45.5 | 44.6 |
|  | CGC | 6 | 37.5 | 0 | 0.0 | 0.0 |  | AAG | 1 | 9.1 | 6 | 54.5 | 55.4 |
|  | CGG | 1 | 6.3 | 0 | 0.0 | 0.0 | MET (M) | ATG | 1 | 100 | 1 | 100 | 100.0 |
|  | CGT | 5 | 31.3 | 5 | 31.3 | 25.7 | PHE (F) | TTC | 3 | 25.0 | 6 | 50.0 | 58.6 |
| ASN (N) | AAC | 3 | 50.0 | 4 | 66.7 | 62.6 |  | TTT | 9 | 75.0 | 6 | 50.0 | 41.4 |
|  | AAT | 3 | 50.0 | 2 | 33.3 | 37.4 | PRO (P) | CCA | 9 | 56.3 | 5 | 31.3 | 29.6 |
| ASP (D) | GAC | 3 | 25.0 | 5 | 41.7 | 42.5 |  | CCC | 6 | 37.5 | 2 | 12.5 | 14.6 |
|  | GAT | 9 | 75.0 | 7 | 58.3 | 57.5 |  | CCG | 1 | 6.3 | 3 | 18.8 | 18.4 |
| CYS (C) | TGC | 6 | 0.0 | 1 | 33.3 | 49.2 |  | CCT | 0 | 0.0 | 6 | 37.5 | 37.3 |
|  | TGT | 3 | 100.0 | 2 | 66.7 | 50.8 | SER (S) | AGC | 0 | 0.0 | 2 | 15.4 | 17.9 |
| END | TAA | 0 | 0.0 | 0 | 0.0 | 0.0 |  | AGT | 4 | 30.8 | 2 | 15.4 | 15.8 |
|  | TAG | 0 | 0.0 | 0 | 0.0 | 0.0 |  | TCA | 3 | 23.1 | 3 | 23.1 | 20.4 |
|  | TGA | 1 | 100.0 | 1 | 100.0 | 100.0 |  | TCC | 3 | 23.1 | 2 | 15.4 | 18.7 |
| GLN (Q) | CAA | 5 | 45.5 | 5 | 45.5 | 50.0 |  | TCG | 1 | 7.7 | 0 | 0.0 | 0.0 |
|  | CAG | 6 | 54.5 | 6 | 54.5 | 50.0 |  | TCT | 2 | 15.4 | 4 | 30.8 | 27.2 |
| GLU (E) | GAA | 13 | 72.2 | 8 | 44.4 | 43.6 | THR (T) | ACA | 3 | 27.3 | 3 | 27.3 | 26.3 |
| 16 | GAG | 5 | 27.8 | 10 | 55.6 | 56.4 |  | ACC | 2 | 18.2 | 3 | 27.3 | 26.9 |
| GLY (G) | GGA | 0 | 0.0 | 5 | 35.7 | 36.4 |  | ACG | 2 | 18.2 | 2 | 18.2 | 16.9 |
|  | GGC | 5 | 35.7 | 2 | 14.3 | 16.2 |  | ACT | 4 | 36.4 | 3 | 27.3 | 30.0 |
|  | GGG | 2 | 14.3 | 2 | 14.3 | 15.2 | TRP (W) | TGG | 6 | 100 | 6 | 100 | 100.0 |
|  | GGT | 7 | 50.0 | 5 | 35.7 | 32.1 | TYR (Y) | TAC | 2 | 22.2 | 5 | 55.6 | 59.4 |
| HIS (H) | CAC | 1 | 20.0 | 3 | 60.0 | 49.6 |  | TAT | 7 | 77.8 | 4 | 44.4 | 40.6 |
|  | CAT | 4 | 80.0 | 2 | 40.0 | 50.4 | VAL (V) | GTA | 0 | 0.0 | 0 | 0.0 | 0.0 |

TABLE 7-continued

Phosphopantetheinyl transferase HetI codon compositions

| Amino Acid | Codon | Original Gene # | Original Gene % | Plnt Opt Gene # | Plnt Opt Gene % | Plnt Opt Recm'd | | Codon | Original Gene # | Original Gene % | Plnt Opt Gene # | Plnt Opt Gene % | Plnt Opt Recm'd |
|---|---|---|---|---|---|---|---|---|---|---|---|---|---|
| ILE (I) | ATA | 2 | 20.0 | 3 | 30.0 | 21.1 | | GTC | 1 | 12.5 | 2 | 25.0 | 27.0 |
| | ATC | 4 | 40.0 | 4 | 40.0 | 42.7 | | GTG | 3 | 37.5 | 3 | 37.5 | 31.7 |
| | ATT | 4 | 40.0 | 3 | 30.0 | 36.2 | | GTT | 4 | 50.0 | 3 | 37.5 | 41.3 |
| | Totals | 116 | | 116 | | | | Totals | 122 | | 122 | | |

After the codon optimization of the coding region sequences were completed, additional nucleotide sequences were added to the optimized coding region sequence. Restriction sites for the facilitation of cloning, a Kozak sequence and additional stop codons were added to the plant optimized coding sequence. In addition, a second series of PUFA synthase OrfA, PUFA synthase OrfB, PUFA synthase chimeric OrfC, acyl-CoA synthetase and phosphopantetheinyl transferase HetI coding sequences were designed which contained a chloroplast targeting sequence from the *Arabidopsis thaliana* Ribulose Bisphosphate Carboxylase small chain 1A (GenBank ID: NM_202369.2). This sequence SEQ ID NO:11 was added to the previously described coding sequences for PUFA synthase OrfA, PUFA synthase OrfB, PUFA synthase chimeric OrfC and phosphopantetheinyl transferase HetI. The initial Methionine from SEQ ID NO:6, SEQ ID NO:7, SEQ ID NO:8, and SEQ ID NO:10 was removed and replaced with the chloroplast targeting sequence. The sequences which contain the chloroplast targeting sequence are identified as version 4 (v4) throughout the specification.

were derived from natural or native sources. Synthesis of DNA fragments comprising SEQ ID NO:6, SEQ ID NO:7, SEQ ID NO:8, SEQ ID NO:9 and SEQ ID NO:10 containing the additional sequences described above were performed by commercial suppliers (Geneart Ag, Regensburg, Germany). The synthetic DNA was then cloned into expression vectors and transformed into *Agrobacterium* and canola as described in Examples 2, 3, and 4.

Employing this method with the codon optimization of the PUFA synthase OrfA coding sequence resulted in the selection of repeated Proline-Alanine sequences that are sufficiently diverged to avoid repeated sequence instability. These sequences were chosen from the deepest branches of the Neighbor-Joining tree (i.e., are the most distantly related to one another in this sequence set). Smith-Wasserman global alignments were done for all pair wise combinations and the range of homology was 74-81% with a probable median of 76-77% (Table 8).

TABLE 8

Smith-Wasserman homologies of selected codon-optimized sequences of repeats of PUFA OrfA.

| | rpt1 nap9 | rpt2 nap10 | rpt3 nap10 | rpt4 nap1 | rpt5 nap10 | rpt6 nap6 | rpt7 nap9 | rpt8 nap4 | rpt9 nap10 |
|---|---|---|---|---|---|---|---|---|---|
| rpt1 nap9 | 100 | 77 | 74 | 77 | 74 | 77 | 81 | 76 | 76 |
| rpt2 nap10 | | 100 | 81 | 76 | 74 | 77 | 79 | 76 | 77 |
| rpt3 nap10 | | | 100 | 79 | 80 | 74 | 74 | 76 | 78 |
| rpt4 nap1 | | | | 100 | 80 | 77 | 75 | 76 | 76 |
| rpt5 nap10 | | | | | 100 | 78 | 77 | 77 | 77 |
| rpt6 nap6 | | | | | | 100 | 78 | 76 | 77 |
| rpt7 nap9 | | | | | | | 100 | 75 | 74 |
| rpt8 nap4 | | | | | | | | 100 | 76 |
| rpt9 nap10 | | | | | | | | | 100 |

A second chloroplast transit peptide was added to the PUFA synthase OrfA, PUFA synthase OrfB, PUFA synthase chimeric OrfC, acyl-CoA synthetase and phosphopantetheinyl transferase HetI coding sequences. These coding sequences were designed to contain a chloroplast targeting sequence from acyl-ACP-thioesterase (GenBank ID: X73849.1). This sequence, SEQ ID NO:38, was added to the previously described coding sequences for PUFA synthase OrfA, PUFA synthase OrfB, PUFA synthase chimeric OrfC and phosphopantetheinyl transferase HetI. The initial Methionine from SEQ ID NO: 6, SEQ ID NO: 7, SEQ ID NO: 8, SEQ ID NO:9 and SEQ ID NO: 10 was removed and replaced with the chloroplast targeting sequence. The sequences which contain the chloroplast targeting sequence are identified as version 5 (v5) throughout the specification.

Once a plant-optimized DNA sequence has been designed on paper or in silico, actual DNA molecules can be synthesized in the laboratory to correspond in sequence precisely to the designed sequence. Such synthetic DNA molecules can be cloned and otherwise manipulated exactly as if they A Clustal W alignment (Vector NTI, Invitrogen, Carlsbad, Calif.) of the chosen 9 newly designed coding regions for the 9 repeated domains is shown in FIG. 1. Overall, the sequences are 93.1% homologous, 61.7% identical as compared to the original sequences which were 100% homologous and 89.7% identical. Greater sequence divergence could be achieved by using more than 10 sequence iterations and employing a computer program or mathematical algorithm to select from these sequences (instead of choosing sequences visually). Nevertheless, the sequences exemplified are highly divergent, and produced stable poly-nucleotide fragments containing nucleotides.

Example 2

Plasmid Construction for pDAB7361, pDAB7362, pDAB7363, and Additional Constructs Construction of pDAB7361

The pDAB7361 plasmid (FIG. 2; SEQ ID NO:35) was constructed using a multi-site Gateway recombination L-R reaction (Invitrogen, Carlsbad, Calif.). pDAB7361 contains three PUFA synthase plant transcription units (PTUs), one acyl-CoA synthetase PTU, one phosphopantetheinyl transferase PTU, and a phosphinothricin acetyl transferase PTU as follows. Specifically, the first PUFA synthase PTU contains a truncated *Phaseolus vulgaris* phytohemagglutinin-L gene promoter (PvDlec2 promoter v2; GenBank Accession Number X06336), *Arabidopsis thaliana* AT2S3 gene 5' untranslated region (2S 5' UTR; GenBank Accession Number NM_118850), *Schizochytrium* sp. PolyUnsaturated Fatty Acid synthase Open Reading Frame A (Sz PUFA OrfA v2) and *Arabidopsis thaliana* 2S albumin gene 3' untranslated region terminator v1 (At2S SSP terminator v1; GenBank Accession Number M22035). The second PUFA synthase PTU contains the PvDlec2 promoter v2, 2S 5' UTR, *Schizochytrium* sp. PolyUnsaturated Fatty Acid synthase Open Reading Frame B (SzPUFA OrfB v3) and At2S SSP terminator v1. The third PUFA synthase PTU contains the PvDlec2 promoter v2, 2S 5' UTR, *Schizochytrium* and *Thraustochytrium* sp. PolyUnsaturated Fatty Acid synthase Open Reading Frame C (hSzThPUFA OrfC v3) and At2S SSP terminator v1. The acyl-CoA synthetase PTU contains the PvDlec2 promoter v2, 2S 5' UTR, *Schizochytrium* sp. acyl-CoA synthetase (SzACS-2 v3) and At2S SSP terminator v1. The phosphopantetheinyl transferase PTU contains the PvDlec2 promoter v2, 2S 5' UTR, *Nostoc* sp. 4' phosphopantetheinyl transferase HetI (NoHetI v3) and At2S SSP terminator v1.

Plasmids pDAB7355, pDAB7335, pDAB7336, pDAB7339 and pDAB7333 were recombined to form pDAB7361. Specifically, the five PTUs described above were placed in a head-to-tail orientation within the T-strand DNA border regions of the plant transformation binary pDAB7333. pDAB7333 also contains the phosphinothricin acetyl transferase PTU: Cassava vein Mosaic Virus Promoter (CsVMV promoter v2; Verdaguer et al., *Plant Molecular Biology* 31:1129-1139; 1996), phosphinothricin acetyl transferase (PAT v5; Wohlleben et al., *Gene* 70:25-37; 1988) and *Agrobacterium tumefaciens* ORF1 3' untranslated region (AtuORF1 3' UTR v4; Huang et al., *J. Bacteriol.* 172:1814-1822; 1990), in addition to other regulatory elements such as Overdrive (Toro et al., *PNAS* 85(22): 8558-8562; 1988) and T-stand border sequences (T-DNA Border A and T-DNA Border B; Gardner et al., *Science* 231:725-727; 1986 and WO 2001/025459 A1). Recombinant plasmids containing the five PTUs were then isolated and tested for incorporation of the five PTUs with restriction enzyme digestion and DNA sequencing.

Construction of pDAB7362

Figure 3:
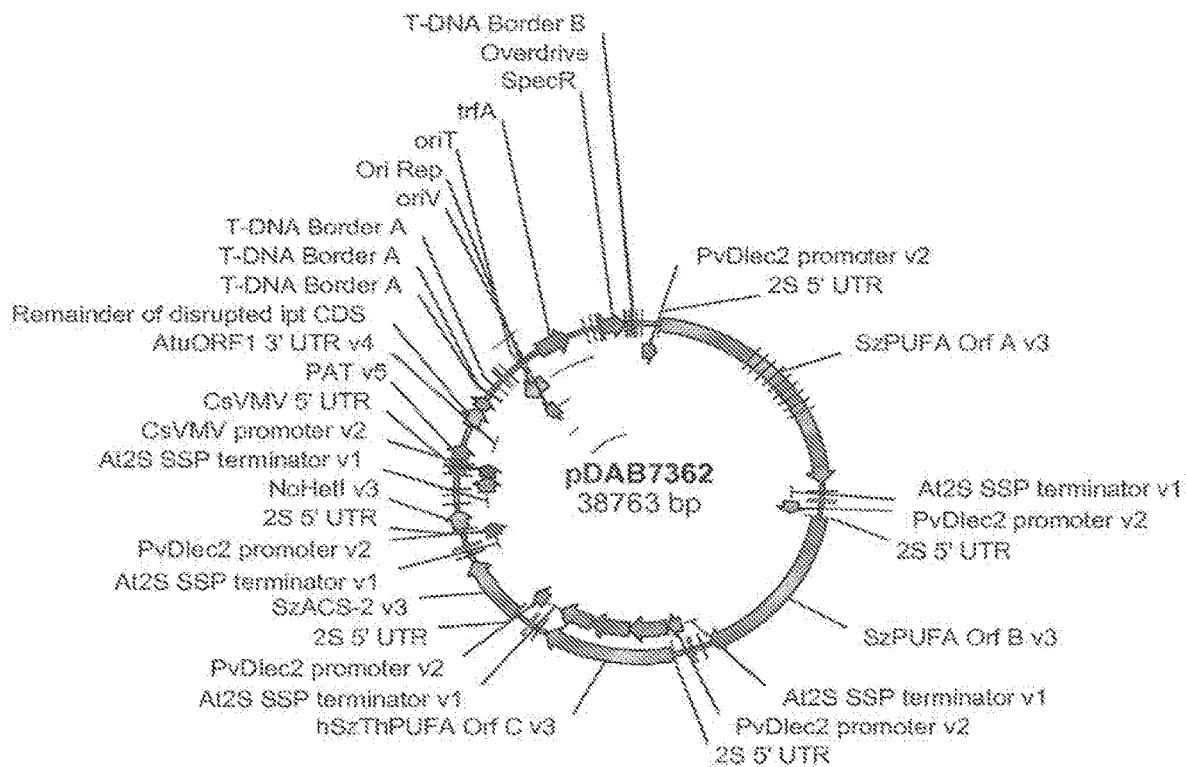
FIG. 3 shows the plasmid map of pDAB7362.

The pDAB7362 plasmid (FIG. 3; SEQ ID NO:36) was constructed using a multi-site Gateway L-R recombination reaction. pDAB7362 contains three PUFA synthase PTUs, one acyl-CoA synthetase PTU, one phosphopantetheinyl transferase PTU sequence and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The acyl-CoA synthetase PTU contains the PvDlec2 promoter v2, 2S 5' UTR, SzACS-2 v3 gene and At2S SSP terminator v1. The phosphopantetheinyl transferase PTU contains the PvDlec2 promoter v2, 2S 5' UTR, NoHetI v3 and At2S SSP terminator v1.

Plasmids pDAB7334, pDAB7335, pDAB7336, pDAB7339 and pDAB7333 were recombined to form pDAB7362. Specifically, the five PTUs described above were placed in a head-to-tail orientation within the T-strand DNA border regions of the plant transformation binary pDAB7333. pDAB7333 also contains the phosphinothricin acetyl transferase PTU: CsVMV promoter v2, PAT v5, AtuORF1 3' UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Figure 4:
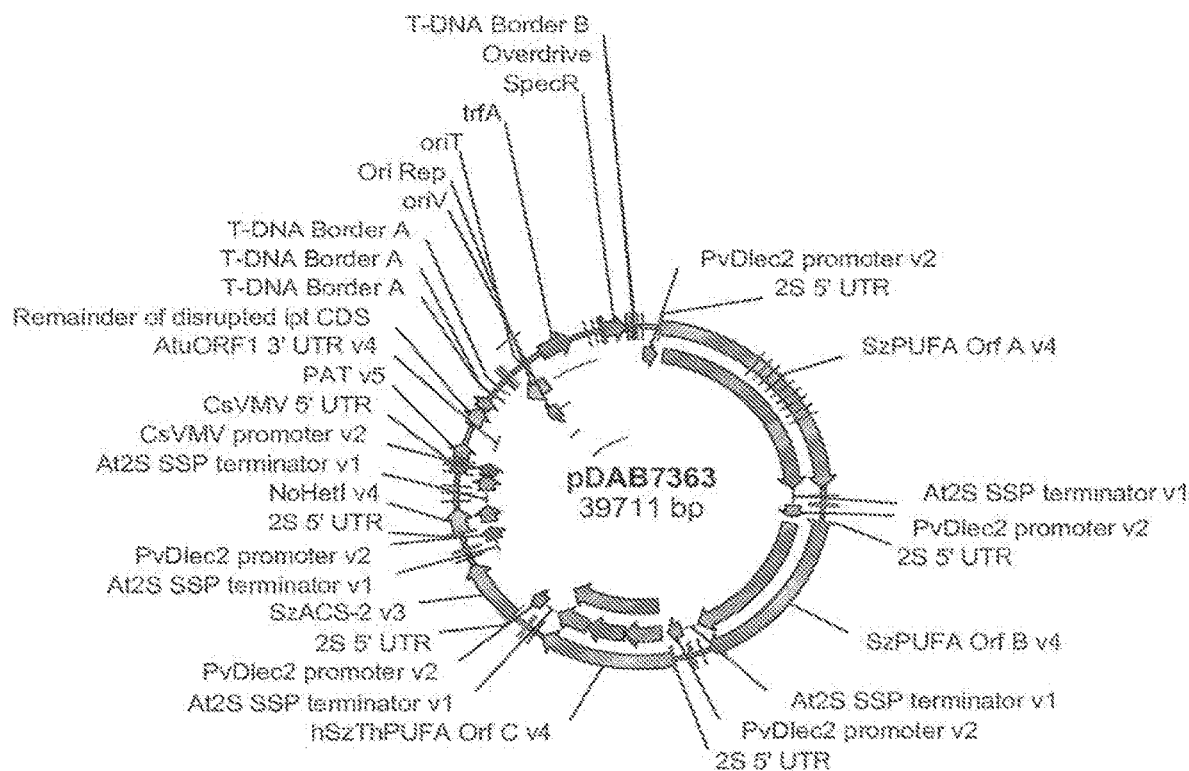
FIG. 4 shows the plasmid map of pDAB7363.

Construction of pDAB7363 pDAB7363 (FIG. 4; SEQ ID NO:37) was constructed using a multi-site Gateway L-R recombination reaction. pDAB7363 contains three PUFA synthase PTUs, one acyl-CoA synthetase PTU and one phosphopantetheinyl transferase PTU sequence. Specifically, the first PUFA synthase PTU contains the PvDlec2 promoter v2, 2S 5' UTR, SzPUFA OrfA v4 and At2S SSP terminator v1. The second PUFA synthase PTU contains the PvDlec2 promoter v2, 2S 5' UTR, SzPUFA OrfB v4 and At2S SSP terminator v1. The third PUFA synthase PTU contains the PvDlec2 promoter v2, 2S 5' UTR, hSzThPUFA OrfC v4 and At2S SSP terminator v1. The acyl-CoA synthetase PTU contains the PvDlec2 promoter v2, 2S 5' UTR, SzACS-2 v3 gene and At2S SSP terminator v1. The phosphopantetheinyl transferase PTU contains the PvDlec2 promoter v2, 2S 5' UTR, NoHetI v4 and At2S SSP terminator v1. In addition, all PTUs also contained the *Arabidopsis thaliana* Ribulose Bisphosphate Carboxylase small chain 1A chloroplast targeting sequence as indicated by the label "v4."

Plasmids pDAB7340, pDAB7341, pDAB7342, pDAB7344 and pDAB7333 were recombined to form pDAB7363. Specifically, the five PTUs described above were placed in a head-to-tail orientation within the T-strand DNA border regions of the plant transformation binary pDAB7333 pDAB7333 also contains the phosphinothricin acetyl transferase PTU: CsVMV promoter v2, PAT v5, AtuORF1 3' UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Figure 19:
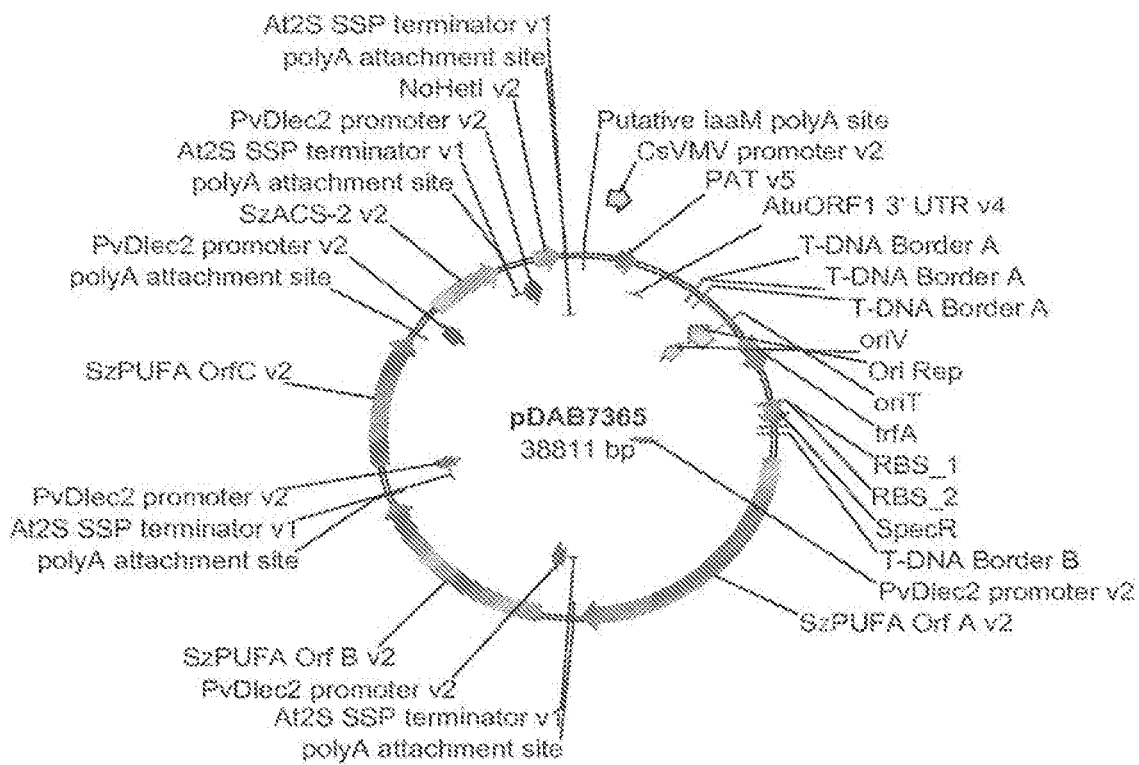
FIG. 19 shows the plasmid map of pDAB7365.

Construction of pDAB7365 pDAB7365 is a binary plasmid that was constructed to contain native, non-codon optimized versions of SzPUFA OrfA v2, SzPUFA OrfB v2, hSzThPUFA OrfC v2, SzACS-2 v2, and NoHetI v2. The pDAB7365 plasmid (FIG. 19; SEQ ID NO:39) was constructed using a multi-site Gateway L-R recombination reaction. pDAB7365 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v2 and At2S SSP terminator v1. The second PUFA synthase PTU contains the PvDlec2 promoter v2, 2S 5' UTR, SzPUFA OrfB v2 and At2S SSP terminator v1. The third PUFA synthase PTU contains the PvDlec2 promoter v2, 2S 5' UTR, SzPUFA OrfC v2 and At2S SSP terminator v1. The acyl-CoA synthetase PTU contains the PvDlec2 promoter v2, 2S 5' UTR, SzACS-2 v2 gene and At2S SSP terminator v1. The phosphopantetheinyl transferase PTU contains the PvDlec2 promoter v2, 2S 5' UTR, NoHetI v2 and At2S SSP terminator v1.

Plasmids pDAB7355, pDAB7356, pDAB7357, pDAB7360 and pDAB7333 were recombined to form pDAB7365. Specifically, the five PTUs described above were placed in a head-to-tail orientation within the T-strand DNA border regions of the plant transformation binary pDAB7333. The order of the genes is: SzPUFA OrfA v2, SzPUFA OrfB v2, SzPUFA OrfC v2, SzACS-2 v2, NoHetI v2. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the six PTUs with restriction enzyme digestion and DNA sequencing.

Figure 20:
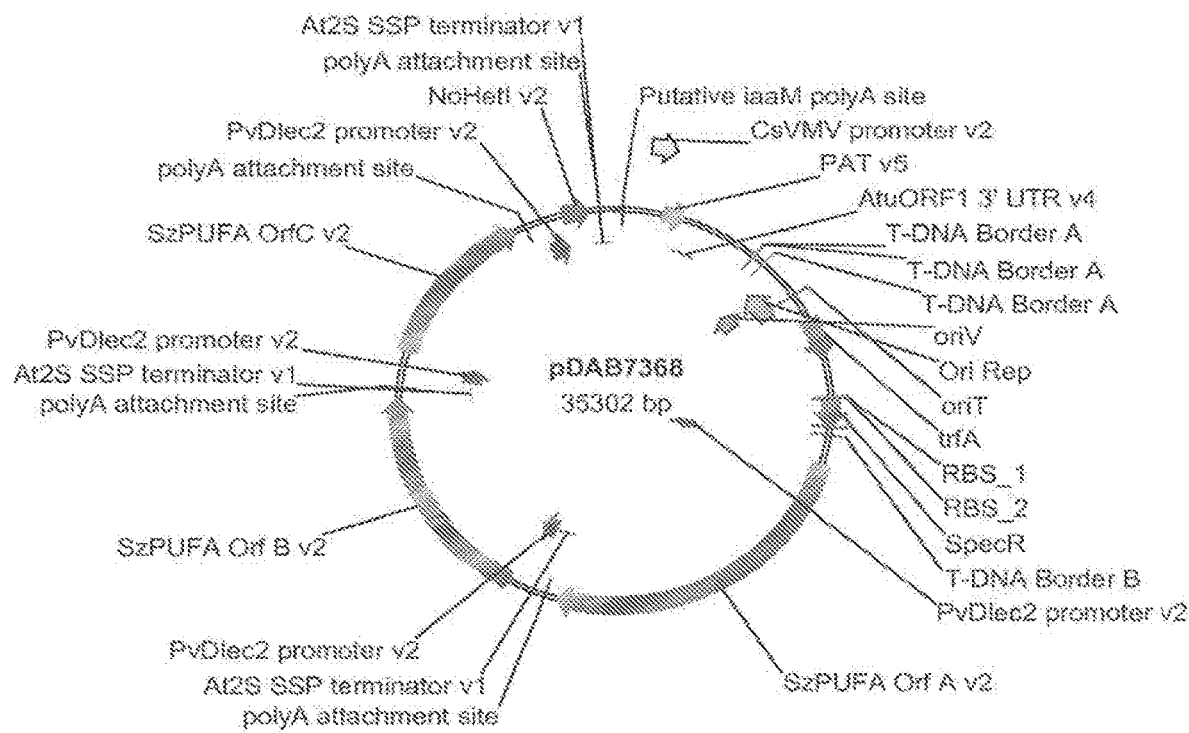
FIG. 20 shows the plasmid map of pDAB7368.

Construction of pDAB7368 pDAB7368 is a binary plasmid that was constructed to contain native, non-codon optimized versions of SzPUFA OrfA v2, SzPUFA OrfB v2, hSzThPUFA OrfC v2, and NoHetI v2. This construct does not contain the SzACS-2 coding sequence. The pDAB7368 plasmid (FIG. 20; SEQ ID NO:40) was constructed using a multi-site Gateway L-R recombination reaction. pDAB7368 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v2 and At2S SSP terminator v1. The second PUFA synthase PTU contains the PvDlec2 promoter v2, 2S 5' UTR, SzPUFA OrfB v2 and At2S SSP terminator v1. The third PUFA synthase PTU contains the PvDlec2 promoter v2, 2S 5' UTR, SzPUFA OrfC v2 and At2S SSP terminator v1. The phosphopantetheinyl transferase PTU contains the PvDlec2 promoter v2, 2S 5' UTR, NoHetI v2 and At2S SSP terminator v1.

Plasmids pDAB7355, pDAB7356, pDAB7357, pDAB7359 and pDAB7333 were recombined to form pDAB7368. Specifically, the four PTUs described above were placed in a head-to-tail orientation within the T-strand DNA border regions of the plant transformation binary pDAB7333. The order of the genes is: SzPUFA OrfA v2, SzPUFA OrfB v2, SzPUFA OrfC v2, NoHetI v2. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Figure 21:
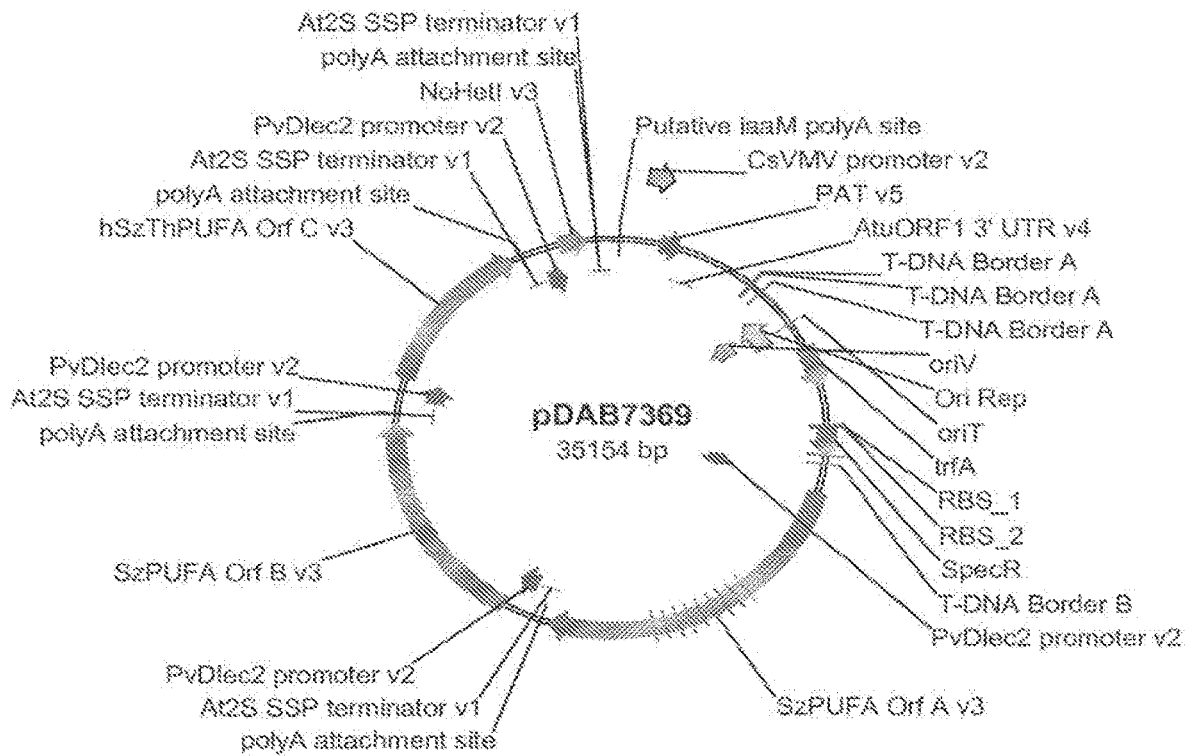
FIG. 21 shows the plasmid map of pDAB7369.

Construction of pDAB7369 pDAB7369 is a binary plasmid that was constructed to contain rebuilt, codon optimized versions of SzPUFA OrfA v3, SzPUFA OrfB v3, hSzThPUFA OrfC v3, and NoHetI v3. This construct does not contain the SzACS-2 coding sequence PTU. The pDAB7369 plasmid (FIG. 21; SEQ ID NO:41) was constructed using a multi-site Gateway L-R recombination reaction. pDAB7369 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The phosphopantetheinyl transferase PTU contains the PvDlec2 promoter v2, 2S 5' UTR, NoHetI v3 and At2S SSP terminator v1.

Plasmids pDAB7334, pDAB7335, pDAB7336, pDAB7338 and pDAB7333 were recombined to form pDAB7369. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Figure 22:
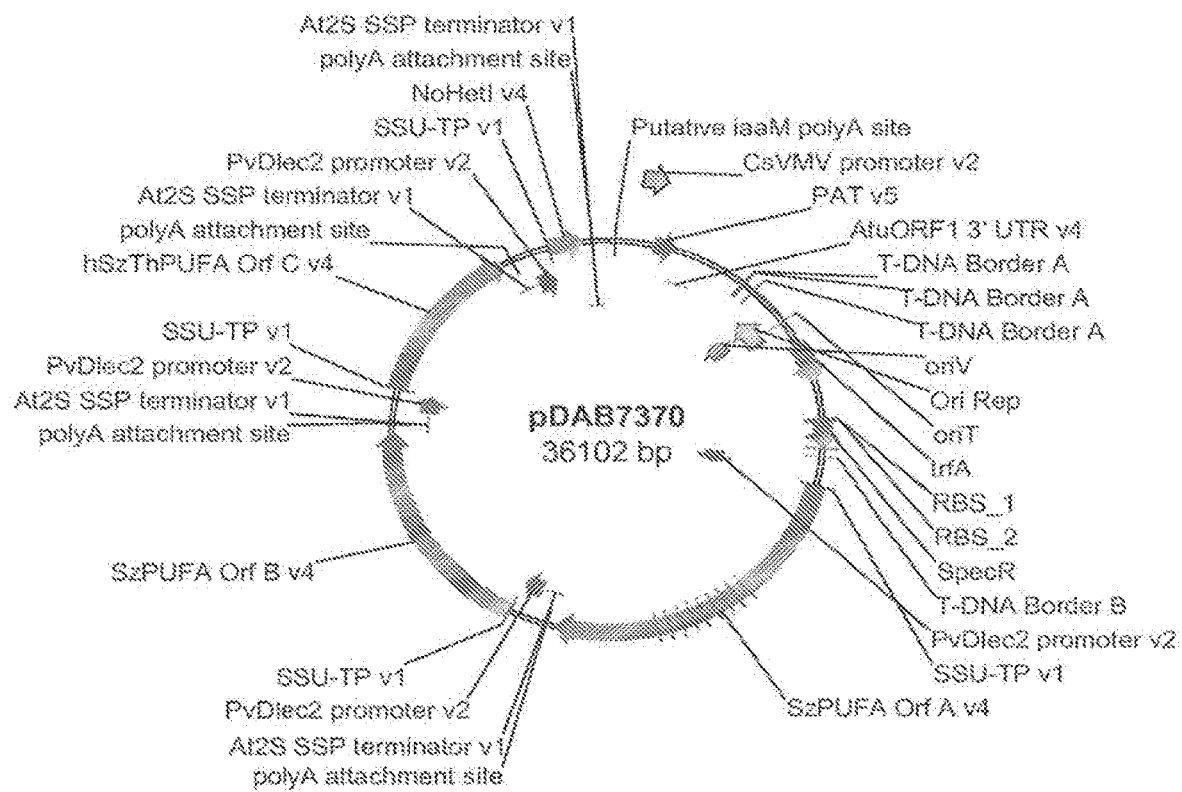
FIG. 22 shows the plasmid map of pDAB7370.

Construction of pDAB7370 pDAB7370 is a binary plasmid that was constructed to contain rebuilt, codon optimized versions of SzPUFA OrfA v4, SzPUFA OrfB v4, hSzThPUFA OrfC v4, and NoHetI v4 which contain the Ribulose Bisphosphate Carboxylase small chain 1A (labeled as SSU-TP v1) which is fused to the amino terminus of the coding sequence. This construct does not contain the SzACS-2 coding sequence PTU. The pDAB7370 plasmid (FIG. 22; SEQ ID NO:42) was constructed using a multi-site Gateway L-R recombination reaction. pDAB7370 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v4 and At2S SSP terminator v1. The second PUFA synthase PTU contains the PvDlec2 promoter v2, 2S 5' UTR, SzPUFA OrfB v4 and At2S SSP terminator v1. The third PUFA synthase PTU contains the PvDlec2 promoter v2, 2S 5' UTR, hSzThPUFA OrfC v4 and At2S SSP terminator v1. The phosphopantetheinyl transferase PTU contains the PvDlec2 promoter v2, 2S 5' UTR, NoHetI v4 and At2S SSP terminator v1.

Plasmids pDAB7340, pDAB7341, pDAB7342, pDAB7343 and pDAB7333 were recombined to form pDAB7370. Specifically, the four PTUs described above were placed in a head-to-tail orientation within the T-strand DNA border regions of the plant transformation binary pDAB7333. The order of the genes is: SzPUFA OrfA v4, SzPUFA OrfB v4, hSzThPUFA OrfC v4, NoHetI v4. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Figure 23:
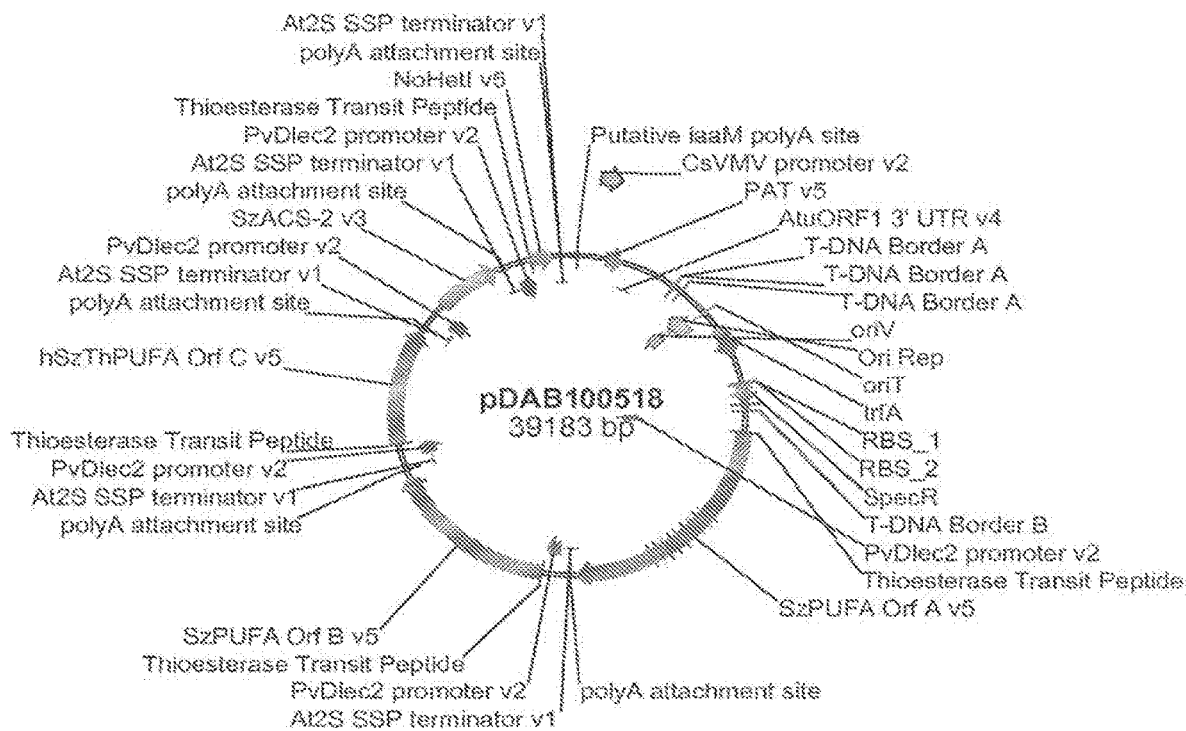
FIG. 23 shows the plasmid map of pDAB100518.

Construction of pDAB100518 pDAB100518 is a binary plasmid that was constructed to contain rebuilt, codon optimized versions of SzPUFA OrfA v5, SzPUFA OrfB v5, hSzThPUFA OrfC v5, and NoHetI v5 which contain the chloroplast transit peptide from acyl-ACP-thioesterase (labeled as Thioesterase Transit Peptide) which is fused to the amino terminus of the coding sequence. In addition, the plasmid contains a SzACS-2 v3 coding sequence PTU which does not possess a chloroplast transit peptide. The pDAB100518 plasmid (FIG. 23; SEQ ID NO:43) was constructed using a multi-site Gateway L-R recombination reaction. pDAB100518 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v5 and At2S SSP terminator v1. The second PUFA synthase PTU contains the PvDlec2 promoter v2, 2S 5' UTR, SzPUFA OrfB v5 and At2S SSP terminator v1. The third PUFA synthase PTU contains the PvDlec2 promoter v2, 2S 5' UTR, hSzThPUFA OrfC v5 and At2S SSP terminator v1. The acyl-CoA synthetase PTU contains the PvDlec2 promoter v2, 2S 5' UTR, SzACS-2 v3 gene and At2S SSP terminator v1. The phosphopantetheinyl transferase PTU contains the PvDlec2 promoter v2, 2S 5' UTR, NoHetI v5 and At2S SSP terminator v1.

Plasmids pDAB100517, pDAB100514, pDAB100511, pDAB100515 and pDAB7333 were recombined to form pDAB100518. Specifically, the five PTUs described above were placed in a head-to-tail orientation within the T-strand DNA border regions of the plant transformation binary pDAB7333. The order of the genes is: SzPUFA OrfA v5, SzPUFA OrfB v5, hSzThPUFA OrfC v5, SzACS-2 v3, NoHetI v5. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the six PTUs were then isolated and tested for incorporation of the six PTUs with restriction enzyme digestion and DNA sequencing.

Figure 24:
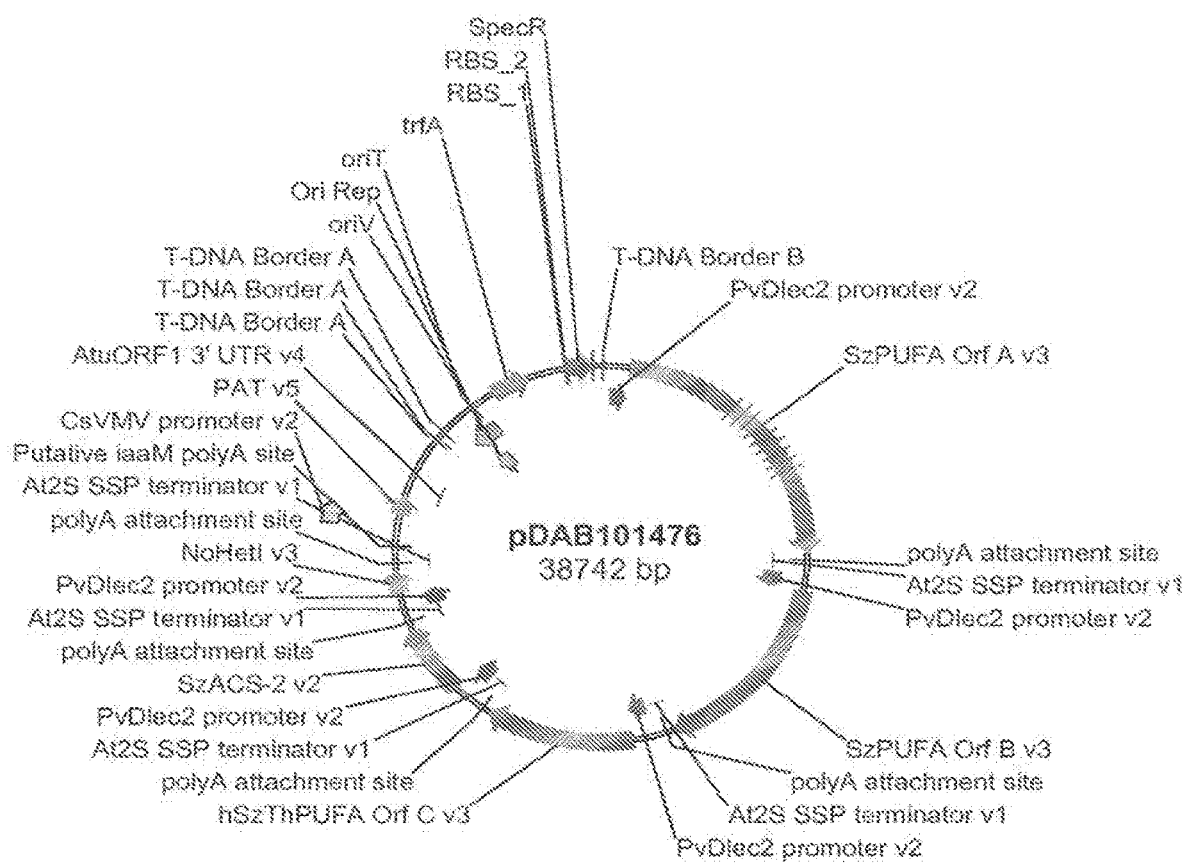
FIG. 24 shows the plasmid map of pDAB101476.

Construction of pDAB101476 pDAB101476 is a binary plasmid that was constructed to contain rebuilt, codon optimized versions of SzPUFA OrfA v3, SzPUFA OrfB v3, hSzThPUFA OrfC v3, and NoHetI v3. The SzACS-2 v2 gene sequence is the native, non-codon optimized version. The pDAB101476 plasmid (FIG. 24; SEQ ID NO:44) was constructed using a multi-site Gateway L-R recombination reaction. pDAB101476 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The acyl-CoA synthetase PTU contains the PvDlec2 promoter v2, 2S 5' UTR, SzACS-2 v2 gene and At2S SSP terminator v1. The phosphopantetheinyl transferase PTU contains the PvDlec2 promoter v2, 2S 5' UTR, NoHetI v3 and At2S SSP terminator v1.

Plasmids pDAB7334, pDAB7335, pDAB7336, pDAB101471 and pDAB7333 were recombined to form pDAB101476. Specifically, the five PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, SzACS-2 v2, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the six PTUs were then isolated and tested for incorporation of the six PTUs with restriction enzyme digestion and DNA sequencing.

Figure 25:
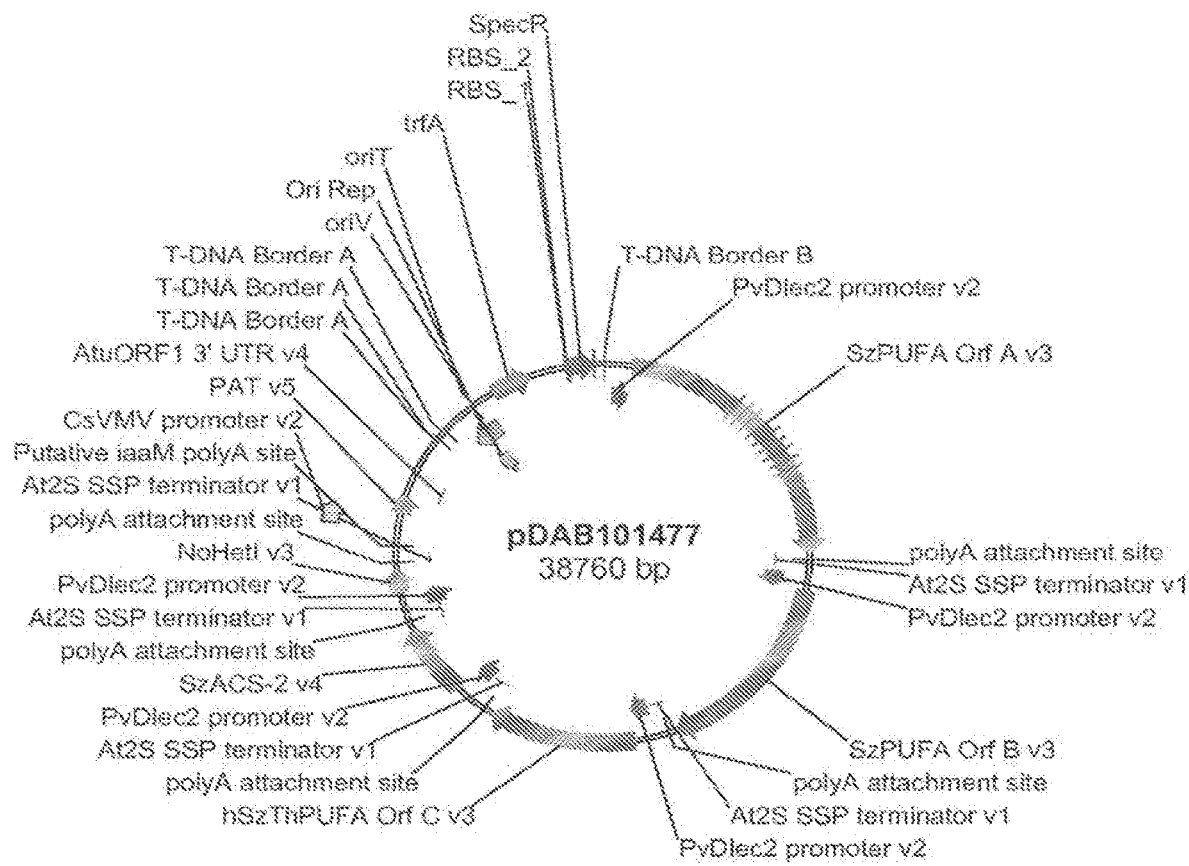
FIG. 25 shows the plasmid map of pDAB101477.

Construction of pDAB101477 pDAB101477 is a binary plasmid that was constructed to contain rebuilt, codon optimized versions of SzPUFA OrfA v3, SzPUFA OrfB v3, hSzThPUFA OrfC v3, and NoHetI v3. The pDAB101477 plasmid (FIG. 25; SEQ ID NO:45) was constructed using a multi-site Gateway L-R recombination reaction. pDAB101477 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The acyl-CoA synthetase PTU contains the PvDlec2 promoter v2, 2S 5' UTR, SzACS-2 v4 gene and At2S SSP terminator v1. The phosphopantetheinyl transferase PTU contains the PvDlec2 promoter v2, 2S 5' UTR, NoHetI v3 and At2S SSP terminator v1.

Plasmids pDAB7334, pDAB7335, pDAB7336, pDAB101472 and pDAB7333 were recombined to form pDAB101477. Specifically, the five PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, SzACS-2 v4, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the six PTUs were then isolated and tested for incorporation of the six PTUs with restriction enzyme digestion and DNA sequencing.

Example 3

*Agrobacterium* Strain Production for Plasmids pDAB7361, pDAB7362, pDAB7363

The pDAB7361, pDAB7362 and pDAB7363 plasmids were transformed into *Agrobacterium tumefaciens* using standard electroporation techniques. Specifically, the *Agrobacterium tumefaciens* strain 27075 (Hepburn et al. J Gen. Microbiol. 131:2961-2969 (1985)) was electroporated with the pDAB7361, pDAB7362 or pDAB7363 plasmids. Transformed colonies of *Agrobacterium* which contained the plasmids were selected and confirmed using restriction enzyme digestion. The *Agrobacterium* strains containing pDAB7361, pDAB7362 or pDAB7363 were stored as glycerol stocks at −80° C.

Example 4

*Agrobacterium*-Mediated Transformation of Canola

*Agrobacterium Preparation*

A loop of glycerol stock of the *Agrobacterium* strains containing either pDAB7361, pDAB7362 or pDAB7363 was used to streak YEP (Bacto Peptone 20.0 gm/L and Yeast Extract 10.0 m/L) plates containing streptomycin (100 mg/ml) and spectinomycin (50 mg/ml) and incubated for 2 days at 28° C. A loop of the 2-day streak plate was then inoculated into 150 mL modified YEP liquid with streptomycin (100 mg/ml) and spectinomycin (50 mg/ml) into sterile 500 mL baffled flask(s) and shaken at 200 rpm at 28° C. The cultures were resuspended in M-medium (LS salts, 3% glucose, modified B5 vitamins, 1 μM kinetin, 1 μM 2,4-D, pH 5.8) and diluted to the appropriate density (50 Klett Units) prior to transformation of canola hypocotyls.

Canola Transformation

Seed Germination:

Canola seeds (variety Nexera 710) were surface-sterilized in 10% Clorox for 10 minutes and rinsed three times with sterile distilled water (seeds are contained in steel strainers during this process). Seeds were planted for germination on ½ MS Canola medium (½ MS, 2% sucrose, 0.8% Agar) contained in Phytatrays, 25 seeds per Phytatray and placed in a Percival chamber with growth regime set at 25° C., photoperiod of 16 hours light, 8 hours dark; and germinated for 5 days.

NEXERA™ 710 is a NEXERA™ canola variety, which have a non-hydrogenated seed oil fatty acid profile ("OMEGA-9 oil") of oleic acid (C18:1) above 70% (by weight) and linolenic acid (C18:3) below 3.5% (by weight), resulting from known mutations in fad2 and fad3 alleles.

Pre-Treatment:

On day 5, ~3 mm hypocotyl segments were aseptically excised, discarding the root and shoot sections (drying of hypocotyls was prevented by placing them into 10 ml of sterile milliQ water during excision process). Hypocotyl segments were placed horizontally on sterile filter paper on callus induction medium MSK1D1 (MS, 1 mg/l Kinetin, 1 mg/l 2,4-D, 3% sucrose, 0.7% Phytagar) for 3 days pre-treatment in a Percival chamber with growth regime set at 22-23° C., (photoperiod of 16 hours light, 8 hours dark).

Co-Cultivation with *Agrobacterium*:

The day before *Agrobacterium* treatment, flasks of YEP medium containing the appropriate antibiotics, were inoculated. Hypocotyl segments were transferred from filter paper to empty 100×25 mm petri dishes containing 10 ml of liquid M medium to prevent the hypocotyl segments from drying. A spatula was used at this stage to scoop the segments and transfer. The liquid M medium was removed with a pipette and 40 ml of *Agrobacterium* suspension added to the petri dish (500 segments with 40 ml of *Agrobacterium* solution). The segments were treated for 30 minutes with periodic swirling of the petri dish so that the hypocotyls stayed immersed in the *Agrobacterium* solution. At the end of the treatment period, the *Agrobacterium* solution was pipetted into a waste beaker, autoclaved and discarded (the *Agrobacterium* solution was completely removed to prevent *Agrobacterium* overgrowth). The treated hypocotyls were transferred with forceps back to the original plates containing MSK1D1 with filter paper (care was taken to ensure that the segments did not dry). The hypocotyl segments along with control segments were returned to the Percival chamber under reduced light intensity (by covering the plates with aluminum foil), and the treated hypocotyls co-cultivated with *Agrobacterium* for 3 days.

Callus Induction on Selection Medium:

After 3 days of co-cultivation, the hypocotyl segments were transferred individually with forceps onto callus induction medium MSK1D1H1 (MS, 1 mg/l Kinetin, 1 mg/l 2,4-D, 0.5 mg/l MES, 5 mg/l AgNO3, 300 mg/l Timentin, 200 mg/l Carbenicillin, 1 mg/l Herbiace, 3% sucrose, 0.7% Phytagar). The hypocotyl segments were anchored on the medium but were not embedded in the medium.

Selection and Shoot Regeneration:

After 7 days on callus induction medium, the callusing hypocotyl segments were transferred to Shoot Regeneration Medium 1 with selection MSB3Z1H1 (MS, 3 mg/l BAP, 1 mg/l Zeatin, 0.5 mg/l MES, 5 mg/l AgNO3, 300 mg/l Timentin, 200 mg/l Carbenicillin, 1 mg/l Herbiace, 3% sucrose, 0.7% Phytagar). After 14 days, the hypocotyls with shoots were transferred to Regeneration Medium 2 with increased selection MSB3Z1H3 (MS, 3 mg/l. BAP, 1 mg/l Zeatin, 0.5 mg/l MES, 5 mg/l AgNO3, 300 mg/l Timentin, 200 mg/l Carbenicillin, 3 mg/l HERBIACE, 3% sucrose, 0.7% Phytagar).

Shoot Elongation:

After 14 days, the segments with shoots were transferred to shoot elongation medium MSMESH5 (MS, 300 mg/l Timentin, 5 mg/l Herbiace, 2% sucrose, 0.7% TC Agar). Shoots that were already elongated were isolated and transferred to MSMESH5. After 14 days the remaining shoots which had not elongated in the first round were placed on MSMESH5 and transferred to fresh selection medium of the same composition. At this stage all remaining hypocotyl segments were discarded.

Shoots that elongated on MSB3Z1H3 medium after 2 weeks were isolated and transferred to MSMESH5 medium. Remaining shoots that had not elongated in the first round on MSMESH5 were isolated and transferred to fresh selection medium of the same composition. At this stage all remaining hypocotyl segments were discarded.

Root Induction:

After 14 days, the shoots were transferred to MSMEST medium (MS, 0.5 g/l MES, 300 mg/l Timentin, 2% sucrose, 0.7% TC Agar for root induction. The shoots that did not root in the first transfer on MSMEST medium were transferred for a second or third cycle on MSMEST medium until rooted plants were obtained. The shoots that did not elongate or root in the first transfer on MSMEST medium were transferred for a second or third cycle on MSMEST medium until the rooted plants were obtained.

PCR Analysis:

Samples for PCR were isolated after the shoots were cultured on MSMESH5 medium for at least 14 days. Leaf tissue from the green shoots was tested by PCR for the presence of the PAT selectable marker gene. All chlorotic shoots were discarded and not subjected to the PAT assay. Samples that were positive for the PCR reaction were kept and the shoots were left on the MSMEST medium to elongate and develop roots. The shoots that were negative according to the PCR assay were discarded.

Plants that rooted on MSMESH5 or MSMEST and were PCR-positive were sent for transplanting into soil. After hardening, the $T_0$ canola plants were further analyzed for events which contained all of the transgene PTU cassettes and then plants were transferred to the greenhouse, grown to maturity and the seed was harvested for additional analysis.

Example 5

Copy Number Analysis and Detection of the Coding Region in Transgenic Canola $T_0$ plants selected from Example 4 were further analyzed to identify plants which contained each of the transgene PTU expression cassettes. Invader and hydrolysis probe assays were performed to initially screen samples of putatively transformed $T_0$ plants to identify events which contained the PAT expression cassette. Subsequent PCR analysis of the PUFA synthase OrfA, PUFA synthase OrfB, PUFA synthase chimeric OrfC, acyl-CoA synthetase and 4' phosphopantetheinyl transferase HetI gene expression cassettes were completed to further identify plants which contained the each gene expression cassette PTU from the binary vector used to transform the plants. Events containing all of the PTUs were selected for advancement to $T_1$ plants.

Tissue samples were collected in 96-well collection plates and lyophilized for 2 days. Tissue maceration was performed with a Kleco tissue pulverizer and tungsten beads (Kleco, Visalia, Calif.). Following tissue maceration the genomic DNA was isolated in high throughput format using the DNeasy 96 Plant kit (Qiagen, Germantown, Md.) according to the manufacturer's suggested protocol.

gDNA was quantified by Quant-IT Pico Green DNA assay kit (Molecular Probes, Invitrogen, Carlsbad, Calif.). Quantified gDNA was adjusted to 10 ng/µl for the Invader® assay or to 2 ng/µl for the hydrolysis probe assay using a Biorobot3000 automated liquid handler (Qiagen, Germantown, Md.).

Custom INVADER® assays were developed for pat analysis within canola by Third Wave Technologies (Madison, Wis.). The gDNA samples (7.5 µl of 10 ng/µl gDNA) were first denatured in 96-well plate format by incubation at 95° C. for 10 minutes and then cooled to ambient temperature. Next, 7.5 µl of master mix (3 µl of probe mix for pat and the HMG internal reference gene (Weng, 2005) Weng H. et al., (2005). *J. AOAC Int.* 88(2):577-84., 3.5 µl Cleavase XI FRET mix, and 1 µl of Cleavase XI Enzyme/MgCl$_2$ solution) were added to each well and the samples were overlayed with mineral oil. Plates were sealed and incubated at 63° C. for 1 hour in a BioRad Tetrad thermocycler. Plates were cooled to ambient temperature before being read on a fluorescence plate reader. All plates contained 1 copy, 2 copy and 4 copy standards as well as wild type control samples and blank wells containing no sample.

Readings were collected for both FAM (λ 485-528 nm) and RED (λ 560-620 nm) channels and from these the fold over zero (i.e., background) for each channel was determined for each sample by the sample raw signal divided by no template raw signal. From this data a standard curve was constructed and the best fit determined by linear regression analysis. Using the parameters identified from this fit, the apparent pat copy number was then estimated for each sample.

Transgene copy number determination by hydrolysis probe assay, analogous to TAQMAN® assay, was performed by real-time PCR using the LIGHTCYCLER®480 system (Roche Applied Science, Indianapolis, Ind.). Assays were designed for pat and the internal reference gene HMG using LIGHTCYCLER® Probe Design Software 2.0. For amplification, LIGHTCYCLER®480 Probes Master mix (Roche Applied Science, Indianapolis, Ind.) was prepared at 1× final concentration in a 10 µL volume multiplex reaction containing 0.4 µM of each primer and 0.2 µM of each probe (Table 8). A two-step amplification reaction was performed with an extension at 60° C. for 35 seconds with fluorescence acquisition. All samples were run in triplicate and the averaged Cycle threshold (Ct) values were used for analysis of each sample.

Analysis of real time PCR data was performed using LIGHTCYCLER® software release 1.5 using the relative quant module and is based on the ΔΔCt method. For this, a sample of gDNA from a single copy calibrator and known 2 copy check were included in each run (identical to those used for Invader assays above).

The presence of the other gene expression cassettes contained in the $T_0$ plant events was detected by individual PCR reactions. Primer pairs (Table 9) specific to the coding regions of these five PTU's were used for detection.

TABLE 9

| Primer and probe information for hydrolysis probe assay of pat and internal reference (HMG) | | |
|---|---|---|
| Primer Name | Sequence | Detection |
| TQPATS | SEQ ID NO: 12; 5' ACAAGAGTGGATTGATGATCTAGAGAGGT 3' | |
| TQPATA | SEQ ID NO: 13; 5' CITTGATGCCTATGTGACACGTAAACAGT 3' | |
| TQPATFQ | SEQ ID NO: 14; 5' CY5-GGTGTTGTGGCTGGTATTGCTTACGCTGG-BHQ2 3' | Cy5 |
| HMGF | SEQ ID NO: 15; 5' CCTCTCTACCACCGTCTCACATG 3' | |
| HMGR | SEQ ID NO: 16; 5' GATCTGGCCGGACTGTTTCA 3' | |
| HMG-HEX | SEQ ID NO: 17; 5' CGCTCCTCAGCTACCACCTCAACCA-IB3' | I Hex |

The PUFA synthase OrfA PCR reactions required two separate PCR reactions and different conditions (e.g., PCR primers and cycling conditions) to amplify the open reading frame of the gene sequence. All of the PCR reactions were completed using the conditions described in Table 10 with 35 cycles using the EX-TAQ PCR kit (TaKaRa Biotechnology Inc. Otsu, Shiga, Japan) per manufacturer's instructions. PCR products were resolved and identified using TAE agarose gel electrophoresis. The expected gel fragment sizes for the PCR products which would indicate the presence of a full length PTU are described in Table 10 in the "Expected sizes" column.

TABLE 10

PCR primers and conditions.

1st Half of Orf A Primers

| ppAB7361 | Sequence | Expected sizes | Conditions | |
|---|---|---|---|---|
| MAS480 SEQ ID NO: 18 | CGAGTTCGGACTCAACATGTTCCA | 2524 bp | 94° C. | 3' |
| MAS554 SEQ ID NO: 19 | AAGGTTGACGCCAGCGACAACGAG | | 94° C. | 30" |
| | | | 60° C. | 30" |
| | | | 72° C. | 2'30" |
| | | | 72° C. | 10' |
| | | | 4° C. | ∞ |

| pDAB7362 and pDAB7363 | Sequence | Expected sizes | Conditions | |
|---|---|---|---|---|
| MAS547 SEQ ID NO: 20 | AAGTTTGGAGTTGGCTTCTGCAGC | 2833 bp | 94° C. | 3' |
| MAS581 SEQ ID NO: 21 | TGAGTTTGGTCTCAACATGTTCCA | | 94° C. | 30" |
| | | | 60° C. | 30" |
| | | | 72° C. | 2'30" |
| | | | 72° C. | 10' |
| | | | 4° C. | ∞ |

2nd Half of Orf A Primers

| pDAB7361 | Sequence | Expected sizes | Conditions | |
|---|---|---|---|---|
| MAS556 SEQ ID NO: 22 | GATGCACGCCAAGGTGGTTGACAT | 2246 bp | 94° C. | 3' |
| MAS481 SEQ ID NO: 23 | TAATGTAGAAGGGCTTGTCCTGCG | | 94° C. | 30" |
| | | | 60° C. | 30" |
| | | | 72° C. | 2'30" |
| | | | 72° C. | 10' |
| | | | 4° C. | ∞ |

| pDAB7362 and pDAB7363 | Sequence | Expected sizes | Conditions | |
|---|---|---|---|---|
| MAS550 SEQ ID NO: 24 | GATGCACGCAAAGGTGGTTGACAT | 2246 bp | 94° C. | 3' |
| MAS572 SEQ ID NO: 25 | TGATGTAGAAGGGTTTGTCTTGTG | | 94° C. | 30" |
| | | | 60° C. | 30" |
| | | | 72° C. | 2'30" |
| | | | 72° C. | 10' |
| | | | 4° C. | ∞ |

Orf B Primers

| pDAB7361, pDAB7362, & pDAB7363 | Sequence | Expected sizes | Conditions | |
|---|---|---|---|---|
| MAS482 SEQ ID NO: 26 | CATGAGATGCATGACGAGAAGAGG | 5476 bp | 94° C. | 3' |
| MAS483 SEQ ID NO: 27 | TGGCAACTTGGTTCACTGTTCCAG | | 94° C. | 30" |
| | | | 60° C. | 30" |
| | | | 72° C. | 5' |
| | | | 72° C. | 10' |
| | | | 4° C. | ∞ |

Chimeric Orf C Primers

| pDAB7361, pDAB7362, & pDAB7363 | Sequence | Expected sizes | Conditions | |
|---|---|---|---|---|
| MAS488 SEQ ID NO: 28 | CGCTTCGTGTCAAGACCAACAAGA | 4354 bp | 94° C. | 3' |
| MAS489 SEQ ID NO: 29 | GCACCACGCAAAATCTGAAGGTTG | | 94° C. | 30" |
| | | | 60° C. | 30" |
| | | | 72° C. | 5' |
| | | | 72° C. | 10' |
| | | | 4° C. | ∞ |

Acs-2 Primers

| pDAB7361, pDAB7362, & pDAB7363 | Sequence | Expected sizes | Conditions | |
|---|---|---|---|---|
| MAS496 SEQ ID NO: 30 | GAACTTCTCTGAAACTGGTGTGGG | 1827 bp | 94° C. | 3' |
| MAS497 SEQ ID NO: 31 | TCACAGGCATCCTCAATGGTCTCA | | 94° C. | 30" |
| | | | 60° C. | 30" |
| | | | 72° C. | 1'30" |
| | | | 72° C. | 10' |
| | | | 4° C. | ∞ |

TABLE 10-continued

PCR primers and conditions.

HetI Primers

| pDAB7361, pDAB7362, & pDAB7363 | Sequence | Expected sizes | Conditions | |
|---|---|---|---|---|
| MAS500 SEQ ID NO: 32 | TCAGATGAGGTTCATCTCTGGAGG | 576 bp | 94° C. | 3' |
| MAS501 SEQ ID NO: 33 | ATCTGGCACAAGCTCCAACAGAGA | | 94° C. | 30" |
| | | | 60° C. | 30" |
| | | | 72° C. | 30" |
| | | | 72° C. | 10' |
| | | | 4° C. | ∞ |

A total of 197 canola events were identified as pat positive from the Invader and hydrolysis probe experiments. Fifteen of these events produced PCR amplicons for all five of the gene expression cassettes (PUFA synthase OrfA, PUFA synthase OrfB, PUFA synthase chimeric OrfC, acyl-CoA synthetase and 4' phosphopantetheinyl transferase HetI) that were contained within the binary used to transform the plants. Table 11 provides the fifteen events which were further analyzed from the production of docosahexaenoic acid (DHA). These $T_0$ canola plants were grown to maturity in the greenhouse and were subsequently self-fertilized. The mature $T_1$ seed was harvested and analyzed for the DHA via GC-FAME analysis.

Example 6

Detection of DHA in Transgenic Canola Seed Lipids

Canola seed samples (either single seeds or bulked samples) were homogenized in heptane containing triheptadecanoin (Nu-Chek prep) as a triacylglycerol internal standard, using steel ball mill. Prior to homogenization, a solution of 0.25 M of freshly prepared sodium methoxide (Sigma-Aldrich, St. Louis, Mo.) in methanol was added. Extraction was conducted at 40° C. with constant shaking. Recoveries were verified by the recovery of the methylated surrogate C17 fatty acid. Extraction of FAMEs (fatty-acid

TABLE 11

PCR detection of docosahexaenoic acid (DHA) producing genes in transgenic canola plants.

| Plasmid Name | Event Name | Copy Number | PCR Reactions | | | | |
|---|---|---|---|---|---|---|---|
| | | | ORFA | ORFB | ORFC | SzACS-2 | HetI |
| pDAB7361 | 5197[13]-010.001 | 1.3 | − | − | + | + | + |
| | 5197[14]-032.002 | 1 | + | + | + | + | + |
| | 5197[21]-052.001 | 4.3 | + | + | + | + | + |
| | 5197[21]-053.001 | 4.6 | + | + | + | + | + |
| | 5197[23]-054.001 | 8.2 | + | + | + | + | + |
| pDAB7362 | 5217[6]-058.001 | 2.5 | + | + | + | + | + |
| | 5217[6]-065.002 | 1.1 | + | + | + | + | + |
| | 5217[1]-021.001 | 3.1 | + | + | + | + | + |
| | 5217[4]-011.001 | 2.0 | + | + | + | + | + |
| | 5217[2]-038.001 | 1.2 | + | + | + | + | + |
| | 5217[2]-039.001 | 5.4 | + | + | + | + | + |
| | 5217[6]-055.001 | 6.0 | + | + | + | + | + |
| | 5217[6]-057.001 | 2.2 | + | + | + | + | + |
| pDAB7363 | 5222[1]-026.001 | 6.3 | + | + | + | + | + |
| | 5222[1]-004.001 | 1.7 | + | + | + | + | + |
| | 5222[7]-029.002 | 2.6 | + | + | + | + | + | methyl esters) was repeated three times and the heptane layers were pooled prior to analysis. The completeness of the reaction was verified by checking for the presence of endogenous FAMEs in a fourth extraction/derivatization. The resulting FAMEs were analyzed by GC-FID using a capillary column BPX 70 from SGE (15 mm×0.25 mm×0.25 µM). Each FAME was identified by retention time and quantified by the injection of a rapeseed oil reference mix from Matreya LLC (Pleasant Gap, Pa.) as a calibration standard with addition of appropriate long chain polyunsaturated fatty acids (Nu-Chek Prep, Elysian Minn.).

FAMEs extract corresponding to seeds from seven events were found to contain peaks corresponding to DHA and DPA (n-6) following the GC-FAME analyses of $T_1$ seed (tabulated below in Table 12). Table 12 shows that the number of DHA-containing seeds varies (as expected from segregation of various copies of the transgene set inserted into the canola genome), as does the maximum content of DHA observed in the single seeds.

TABLE 12

LC-PUFA content of T1 seed from seven transgenic canola events containing genes for the PUFA synthase genes, SzACS-2 and HetI.

| Plasmid (pDAB) | Event Name | PAT Copy # | Number of DHA positive seeds[1] | Avg DHA content[2] | Avg DPA content[2] | Avg Total PUFA[3] | Avg n-3/PUFA[4] | Highest DHA content[5] |
|---|---|---|---|---|---|---|---|---|
| 7361 | 5197[13]-010.001 | 1.3 | 75/96 | 0.36 | 0.15 | 0.51 | 70% | 0.81 |
| 7361 | 5197[14]-032.002 | 1 | 67/96 | 0.43 | 0.12 | 0.55 | 78% | 1.05 |
| 7361 | 5197[21]-052.001 | 4.3 | 5/24 | 0.02 | 0.01 | 0.03 | 81% | 0.05 |
| 7361 | 5197[21]-053.001 | 4.6 | 32/48 | 0.07 | 0.03 | 0.11 | 64% | 0.22 |
| 7362 | 5217[6]-058.001 | 2.5 | 13/48 | 0.36 | 0.23 | 0.61 | 60% | 1.02 |
| 7362 | 5217[6]-065.002 | 1.1 | 16/48 | 0.15 | 0.09 | 0.25 | 61% | 0.23 |
| 7363 | 5222[1]-026.001 | 6.3 | 46/48 | 0.09 | 0.05 | 0.16 | 59% | 0.40 | a. Number of seeds that contained detectable DHA/total number of seeds analyzed from the T1 bulk.
b. Average DHA content (% of total lipids) of all the DHA-positive seeds.
c. Average PUFA content (% of total lipids) of all the DHA-positive seeds.
d. Average % ratio of DHAn-3/total LC-PUFA (DHA + DPAn-6)
e. Highest DHA content observed in a single seed.

The developing seed from an additional event was analyzed and found to contain DHA but the mature plant yielded insufficient $T_1$ seed for further analysis. The long chain polyunsaturated fatty acids (LC-PUFA) peak identities were confirmed by mass spectrometry analysis and compared with authentic standards (Nu-Chek Prep, Elysian Minn.).

Figure 5:
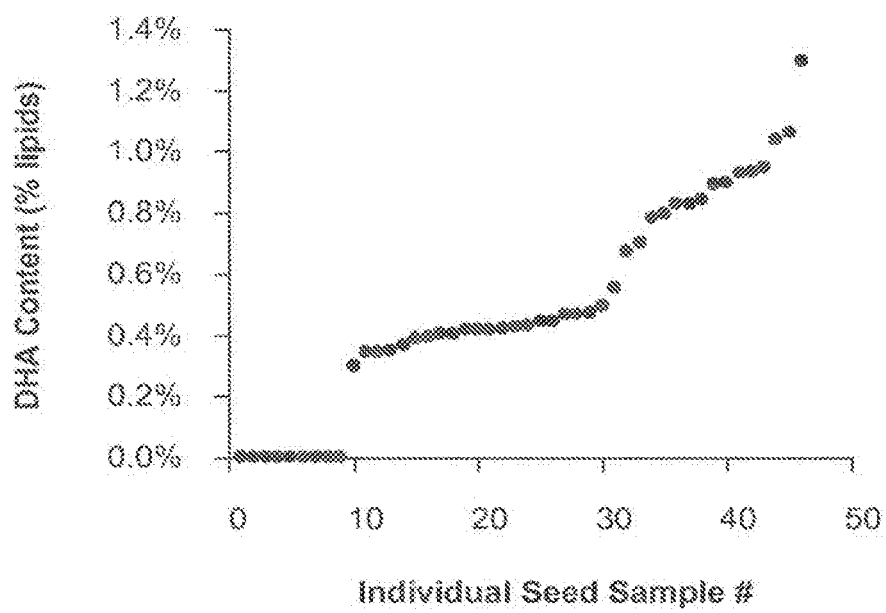
FIG. 5 shows single seed analysis of the DHA content of $T_1$ seeds from canola event 5197[14]-032.002.

The single seed analysis for DHA content of $T_1$ seeds from one event (Event 5197[14]-032.002) is shown in FIG. 5. Single seeds contained up to 1% DHA (as % of total FAMEs). The DHA levels appear to segregate into three classes (0, ~0.4% and ~0.9% DHA) reflecting segregation of a single locus containing the DHA-producing genes.

These data indicate that DHA was produced in plants transformed with plasmids pDAB7361, pDAB7362 and pDAB7363. The pDAB7362 plasmid contains plant-optimized versions of all five genes (encoding PUFA synthase OrfA, PUFA synthase OrfB, PUFA synthase chimeric OrfC, acyl-CoA synthetase and 4' phosphopantetheinyl transferase HetI) driven by the *Phaseolus vulgaris* phytohemagglutinin-L gene promoter. In pDAB7361, a native gene sequence of PUFA synthase OrfA (SzOrfA v2) replaces the plant-optimized version (SzOrfA v3). pDAB7363 is also similar to pDAB7362 except that a *Arabidopsis thaliana* Ribulose Bisphosphate Carboxylase small chain 1A chloroplast transit peptide is added to the N-terminus of PUFA synthase OrfA, PUFA synthase OrfB, PUFA synthase chimeric OrfC, and 4' phosphopantetheinyl transferase HetI to target these polypeptides to the plastid.

Example 7

Detection of PUFA Synthase Proteins in Canola Seed

PUFA synthase polypeptides were detected in mature transgenic seed samples by Western blot. Seed was prepared for analysis by cracking dry seed with 2 stainless steel beads in a Kleco Bead Beater (Garcia Machine, Visalia, Calif.). Extraction buffer was added (50 mM Tris, 10 mM EDTA, 2% SDS) and sample tubes were rocked gently for 30 minutes. Samples were centrifuged for 30 minutes at 3000 rcf. The supernatant was collected and used for analysis. The amount of total soluble protein in the seed extract was determined by Lowry assay (BioRad, Hercules, Calif.). Samples were normalized to 1.55 mg/ml total soluble protein and prepared in LDS sample buffer (Invitrogen, Carlsbad, Calif.) with 40 mM DTT for a normalized load of 20 µg total soluble protein per lane. Samples were electrophoresed in 3-8% Tris acetate gels (Invitrogen, Carlsbad, Calif.) and transferred to nitrocellulose membranes. Blots were blocked in blocking buffer and probed with antibodies against the different PUFA synthase OrfA, OrfB and OrfC polypeptides. The Rabbit anti-A2-A which is directed against the A2 region of *Schizochytrium* PUFA Synthase subunit A (SzPUFS-A) and the Rabbit anti-B3-A which is directed against the B3 region of Schizochytrium PUFA Synthase subunit B (SzPUFS-B) were used. Region B3 is the Enoyl Reductase (ER) region. There is also an ER region in subunit C, so this antiserum will recognize both subunits B and C on a western blot. An anti-rabbit fluorescent labeled secondary antibody (Goat Anti-Rabbit AF 633 (Invitrogen, Carlsbad, Calif.)) was used for detection. Blots were visualized on a Typhoon Trio Plus fluorescent imager (GE Healthcare, New Brunswick N.J.).

Figure 6:
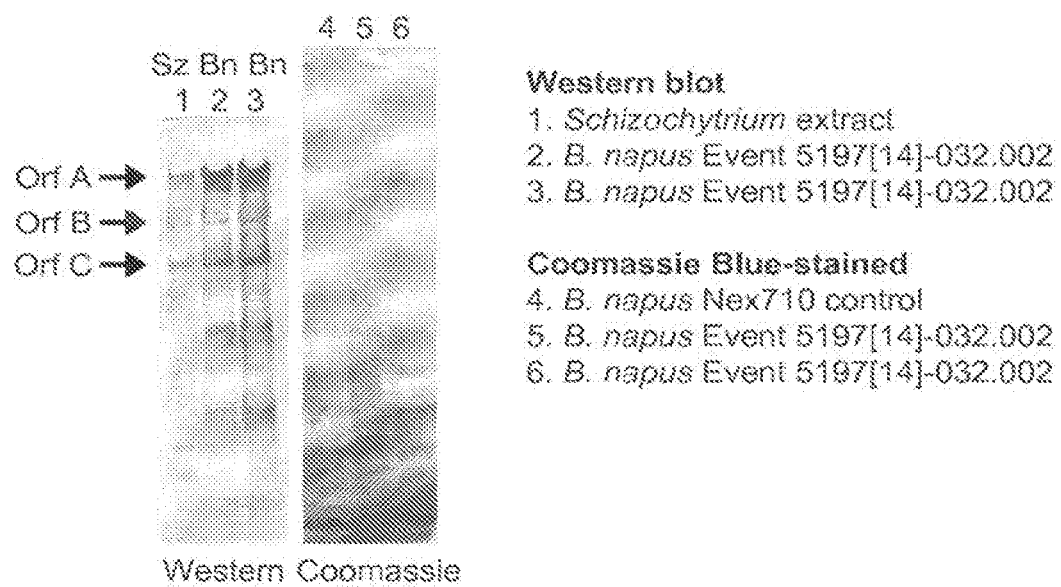
FIG. 6 shows the results of SDS-PAGE western blots of extracts from late stage (>30 DAP) developing T1 seed from canola event 5197[14]-032.002 probed with Orf A, Orf B and Orf C specific antisera.

SDS-PAGE western blots of extracts from late stage (>30 DAP) developing T1 seed from event 5197[14]-032.002 showed bands at the appropriate size when probed with Orf A, Orf B and Orf C specific antisera (FIG. 6). These bands could also be seen by direct staining with Coomassie Blue. Orf A, Orf B and Orf C have also been detecting in seed samples from DHA producing events 5197[13]-010.001, 5197[21]-052.001, 5197[21]-053.001 and 5217[6]-065.002.

Figure 7A:
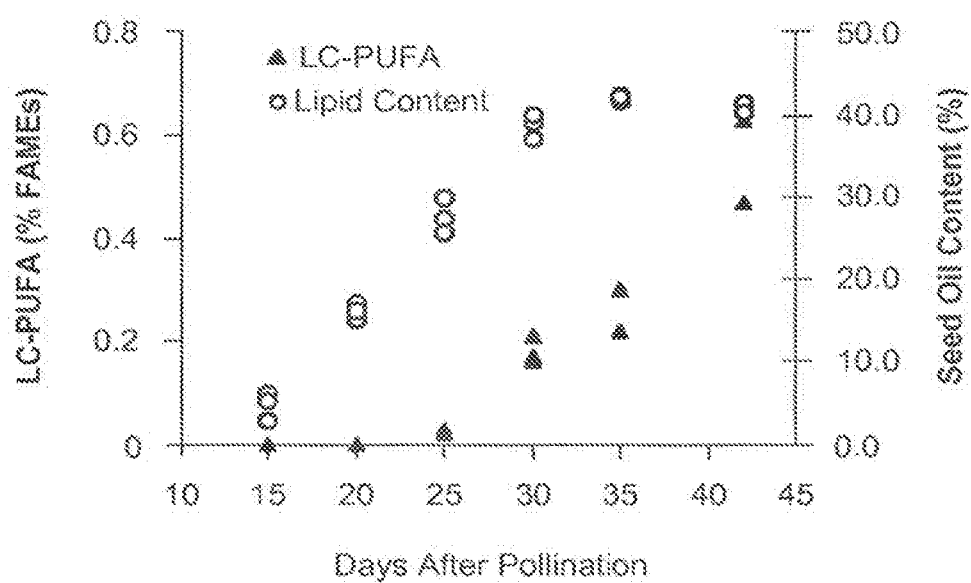
FIG. 7a shows the lipid content of developing T2 seed samples collected 15, 20, 25, 30, 35 and 42 days after pollination from the DHA-producing canola event 5197 [14]-032.002.Sx002.
Figure 7B:
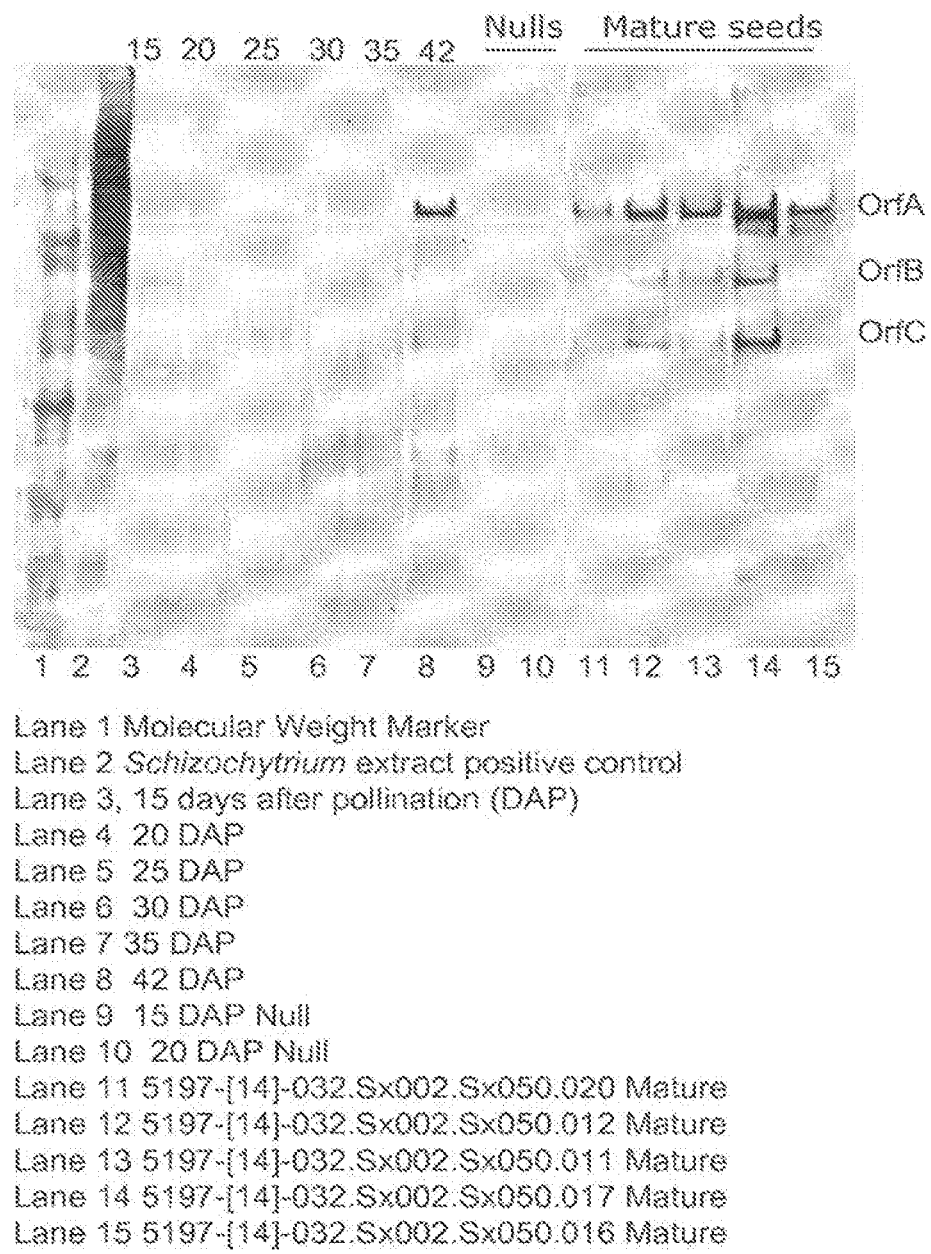
FIG. 7b shows the presence of the OrfA, OrfB and OrfC polypeptides in extracts from DHA-producing canola event 5197[14]-032.002.Sx002 by western blot.

A set of developing T2 seed samples collected 15, 20, 25, 30, 35, and 42 days after pollination (DAP) from DHA-producing canola event 5197[14]-032.002.Sx002 were analyzed for lipid content (FIG. 7a) and the presence of the OrfA, OrfB and OrfC polypeptides by western blot (FIG. 7b).

Expression of all three polypeptides was detected in developing seed at 30 and 35 days after pollination, and prominently detected at 42 days after pollination and in the mature seed (FIGS. 7a and 7b).

Example 8

DHA, DPA and EPA Levels in $T_2$ Canola Seeds $T_1$ seeds from Event 5197[14]-032.002 were planted in the greenhouse and leaf samples were taken from 96 plants at the 4-5 leaf stage for DNA analysis to determine the number of copies of the transgene in each $T_1$ segregant plant. This was performed by Hydrolysis probe assays of the pat gene, using the protocol described above, and identified three distinct classes of segregants; 21 homozygous, 45 heterozygous and 30 null plants. All of the homozygous and 31 null plants were grown to maturity in the greenhouse and the seed harvested. Average $T_2$ seed yield per plant from the homozygous and null plants were 7.36 gm and 8.61 gm respectively.

Figure 8:
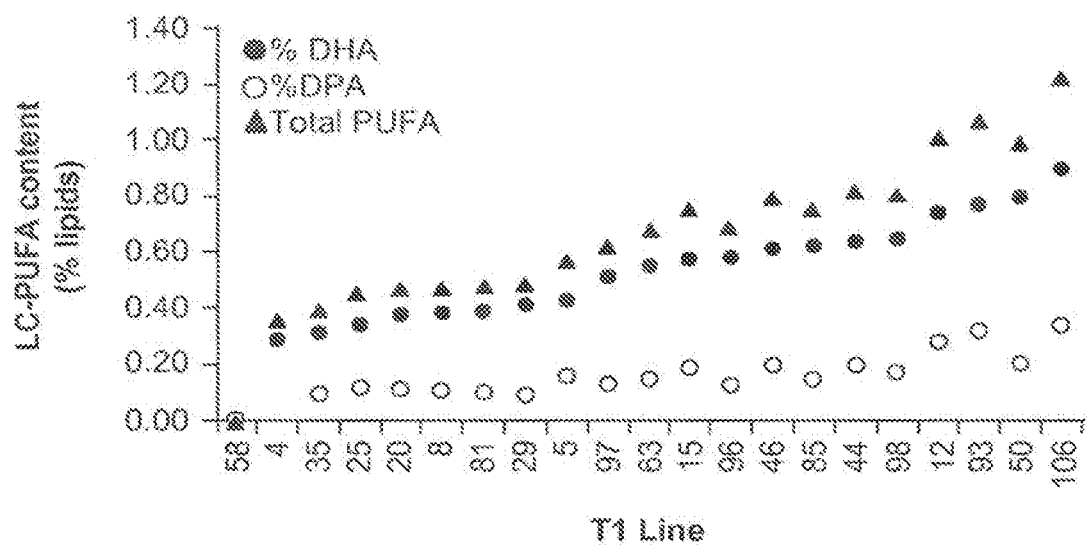
FIG. 8 shows the LC-PUFA content of homozygous T2 plants from the greenhouse-grown T1 plants of canola event 5197[14]-032.002.

The long-chain polyunsaturated fatty acids (LC-PUFA) content of $T_2$ seeds from the greenhouse-grown $T_1$ plants of Event 5197[14]-032.002 were determined in bulk extractions of 8-12 seeds by GC-FAME analysis, as previously described. 21 null segregant plants were also grown to maturity as controls. The LC-PUFA content of the homozygous plants is shown in FIG. 8. No LC-PUFAs were detected in seeds from any of the null segregants. Twenty of the transgenic lines produced between 0.28% and 0.90% DHA in the bulk seed analyses and one line failed to produce any LC-PUFA. The DHA-containing seeds also contained between 0.09 and 0.34% DPA (n-6). The average proportion of DHA in total PUFA (DHA+DPA) was 77%.

The fatty acid composition of seed from four lines producing over 0.7% DHA is shown in Table 13 in comparison with that from four null segregant lines

TABLE 13

Fatty acid composition of bulk T2 seeds from four transgenic lines and four null segregants from Event 5197[14]-032.002.

| Line ID | Zygosity | C14:0 | C16:0 | C16:1 | C18:0 | C18:1 | C18:2 | C18:3 |
|---|---|---|---|---|---|---|---|---|
| 5197-[14]-032.002.Sx002.012 | HOMO | 0.05 | 3.49 | 0.24 | 1.69 | 76.33 | 10.87 | 3.80 |
| 5197-[14]-032.002.Sx002.093 | HOMO | 0.07 | 3.50 | 0.24 | 1.67 | 76.10 | 11.39 | 3.63 |
| 5197-[14]-032.002.Sx002.050 | HOMO | 0.05 | 3.43 | 0.24 | 1.87 | 77.73 | 9.72 | 3.48 |
| 5197-[14]-032.002.Sx002.010 | HOMO | 0.06 | 3.48 | 0.24 | 1.70 | 75.53 | 11.63 | 3.73 |
| 5197-[14]-032.002.Sx002.011 | NULL | 0.06 | 3.59 | 0.23 | 1.68 | 76.56 | 12.08 | 3.24 |
| 5197-[14]-032.002.Sx002.032 | NULL | 0.06 | 3.63 | 0.25 | 1.60 | 76.28 | 12.21 | 3.33 |
| 5197-[14]-032.002.Sx002.037 | NULL | 0.05 | 3.74 | 0.25 | 1.61 | 77.46 | 10.78 | 3.35 |
| 5197-[14]-032.002.Sx002.048 | NULL | 0.06 | 3.61 | 0.24 | 1.61 | 75.83 | 12.54 | 3.67 |

| Line ID | Zygosity | C20:0 | C20:1 | C22:0 | C22:1 | C24:0 | C22:5 | C22:6 |
|---|---|---|---|---|---|---|---|---|
| 5197-[14]-032.002.Sx002.012 | HOMO | 0.67 | 1.25 | 0.39 | 0.02 | 0.18 | 0.28 | 0.74 |
| 5197-[14]-032.002.Sx002.093 | HOMO | 0.60 | 1.21 | 0.33 | 0.02 | 0.16 | 0.32 | 0.77 |
| 5197-[14]-032.002.Sx002.050 | HOMO | 0.70 | 1.18 | 0.39 | 0.02 | 0.19 | 0.20 | 0.80 |
| 5197-[14]-032.002.Sx002.010 | HOMO | 0.62 | 1.22 | 0.36 | 0.02 | 0.16 | 0.34 | 0.90 |
| 5197-[14]-032.002.Sx002.011 | NULL | 0.68 | 1.29 | 0.37 | 0.03 | 0.20 | 0.00 | 0.00 |
| 5197-[14]-032.002.Sx002.032 | NULL | 0.67 | 1.31 | 0.40 | 0.03 | 0.23 | 0.00 | 0.00 |
| 5197-[14]-032.002.Sx002.037 | NULL | 0.70 | 1.37 | 0.42 | 0.01 | 0.26 | 0.00 | 0.00 |
| 5197-[14]-032.002.Sx002.048 | NULL | 0.64 | 1.24 | 0.35 | 0.01 | 0.19 | 0.00 | 0.00 |

Single seed analysis of 48 $T_2$ seeds from six lines of these homozygous $T_1$ plants (4, 35, 63, 96, 50, and 106) was performed. Detailed analysis of the GC-FAME profile showed that an additional peak was consistently present in seeds containing DHA and DPA. This was identified as C20:5(n-3) EPA by comparison with an authentic standard (NU-Chek). The retention time matched that for authentic EPA (C20:5 (n-3)) and the nomimal molecular mass determined by GC-MS via the Polaris was identical.

Figure 9:
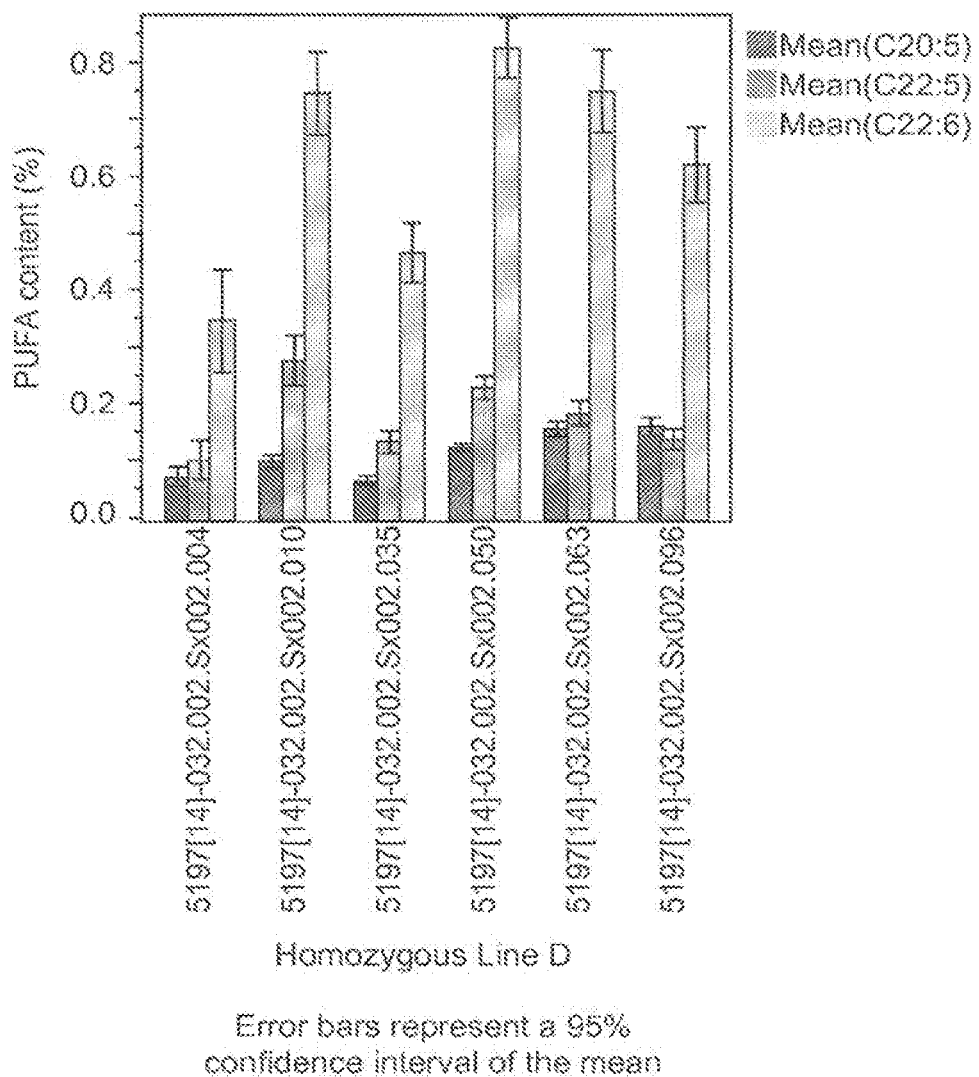
FIG. 9 shows a summary of the LC-PUFA of single T2 seed analyses from six homozygous lines.

A summary of the LC-PUFA of the single $T_2$ seed analyses from the six lines is Shown in FIG. 9. Single seeds with DHA content up to 1.6% were found. In addition plants with EPA content up to 0.27% were identified.

Figure 10:
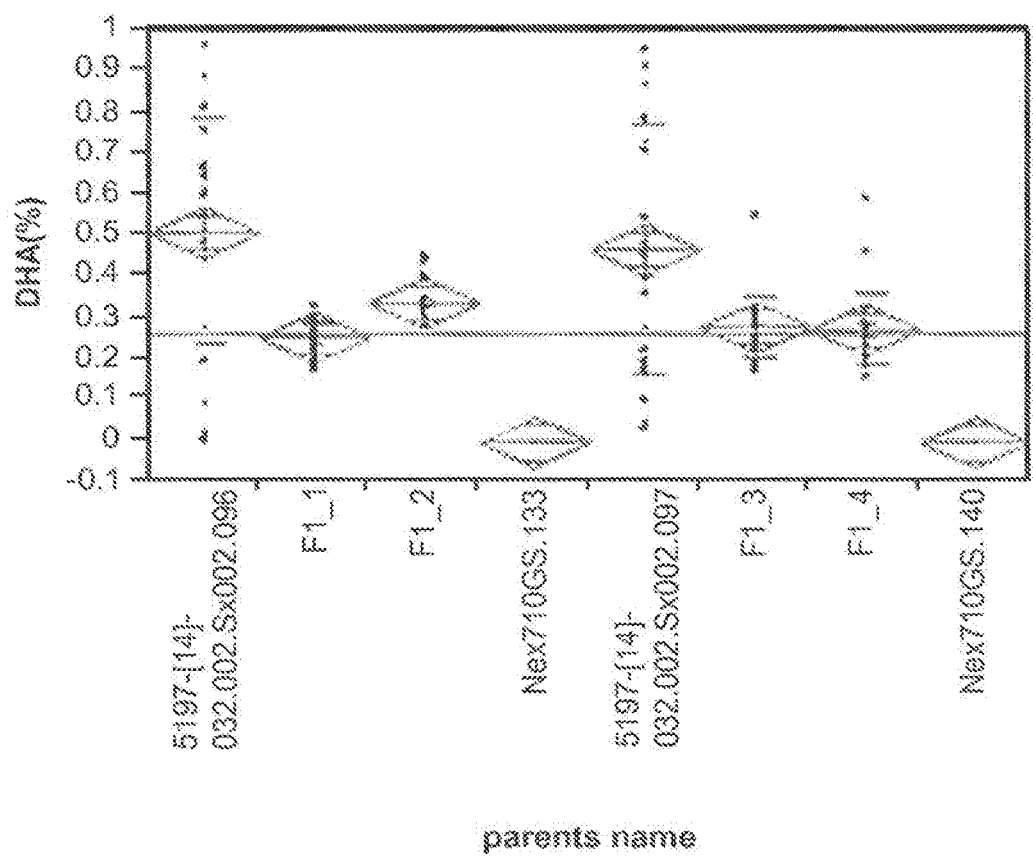
FIG. 10 shows DHA content of the resulting parent and F1 hybrid seeds from a reciprocal cross of two $T_1$ lines and untransformed Omega-9 Nexera 710.

Reciprocal crosses were made between two $T_1$ lines and untransformed Nexera710. The resulting parent and F1 hybrid seeds were analyzed for DHA content (FIG. 10). In FIG. 10, diamonds represent the mean ANOVA for each category described on the X axis. The vertical bar represents the mean for the category and the distance between the extreme of the diamond is the 95% confidence interval. The average level of DHA accumulation in F1 seed (0.29% and 0.28%) is half of what the transgenic parent seed are accumulating (0.51% and 0.47%). A quantitative correlation of the phenotype and zygosity level can be deduced from this result.

In summary, these data show that the DHA trait conferred by the five transgenes is heritable and is maintained into a second generation.

Example 9

DHA Production in Canola Event-10 T2 Seed

Figure 11:
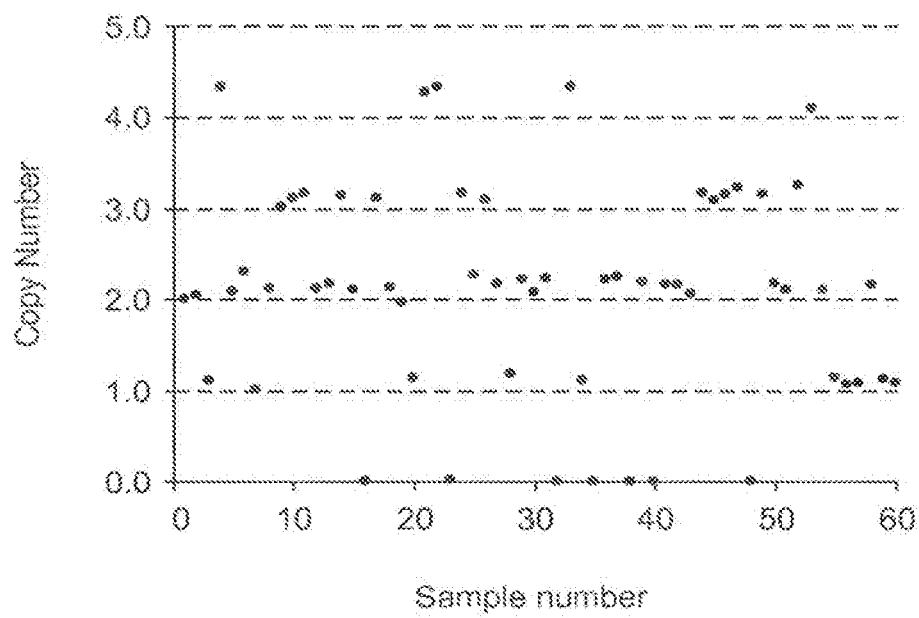
FIG. 11 shows pat gene copy number of sixty individual T1 plants derived from canola event 5197[13]-010.001.

Sixty $T_1$ seeds from canola event 5197[13]-010.001 (containing two copies of the pat gene as shown in FIG. 11) were planted in the greenhouse. Hydrolysis probe assays of the pat gene identified five distinct classes of segregants corresponding to 0-4 copies of the pat gene.

The two loci corresponding to the transgenic inserts could be distinguished by Southern blot, analysis (denoted locus A and B). DNA from all of the plants containing two pat copies were analyzed by Southern blot to determine their genotype (homozygous for locus A or locus B, or hemizygous for both loci). Four single copy and two null control plants were also analyzed as controls. All of the $T_1$ plants were grown to maturity in the greenhouse. The seed was harvested and analyzed in bulk seed analyses for LC-PUFA content (Table 14).

TABLE 14

LC-PUFA content of $T_2$ seeds from $T_1$ segregants from Event 5197[13]-010.001 (Means were compared by Tukey-Kramer HSD Test and levels not connected with same latter are significantly different.)

| Genotype | PAT Copy # | # of T1 plants analyzed | Average LC-PUFA Content % total FAMEs | SE | Statistical Significance |
|---|---|---|---|---|---|
| Null | 0 | 5 | 0.00 | 0.07 | d |
| Hemizygous at locus A | 1 | 2 | 0.47 | 0.11 | ab |
| Hemizygous at locus B | 1 | 2 | 0.02 | 0.11 | bcd |
| Hemizygous at locus A & B | 2 | 13 | 0.15 | 0.04 | bcd |
| Homozygous at locus A | 2 | 4 | 0.65 | 0.08 | a |
| Homozygous at locus B | 2 | 5 | 0.00 | 0.07 | cd |
| Homozygous at one locus, hemizygous at the other | 3 | 13 | 0.03 | 0.04 | d |
| Homozygous Locus A & B | 4 | 5 | 0.00 | 0.07 | d |

These data show that plants that are homozygous at Event 5197[13]-010.001 locus A direct the production of LC-PUFA whereas locus B homozygotes do not. Furthermore locus B interferes with LC-PUFA production as four-copy double homozygotes produce very low levels of DHA as do the three-copy plants. Similarly hemizygous single-copy locus A plants produce 0.47% LC-PUFA, whereas hemizygous single-copy locus B produce very low levels of LC-PUFA (0.02%).

The complete fatty composition determined by GC-FAME analysis of the bulk T2 seed from plants derived from event Event 5197[13]-010.001 that were homozygous at locus A (and null for locus B) is shown in Table 15.

TABLE 15

Fatty acid composition of $T_2$ seed from event Event 5197[13]-010.001 homozygous at locus A

| Line ID | C14:0 | C16:0 | C16:1 | C18:0 | C18:1 | C18:2 | C18:3 | C20:0 |
|---|---|---|---|---|---|---|---|---|
| 5197 [13]-010.Sx001.008 | 0.05 | 3.46 | 0.23 | 0.57 | 79.40 | 10.23 | 3.09 | 0.65 |
| 5197 [13]-010.Sx001.015 | 0.05 | 3.53 | 0.25 | 1.42 | 78.36 | 10.57 | 3.17 | 0.61 |
| 5197 [13]-010.Sx001.050 | 0.05 | 3.60 | 0.24 | 1.72 | 77.40 | 10.73 | 3.15 | 0.59 |
| 5197 [13]-010.Sx001.051 | 0.05 | 3.63 | 0.26 | 1.48 | 78.41 | 10.32 | 3.01 | 0.58 |

| Line ID | C20:1 | C22:0 | C22:1 | C20:5 | C24:0 | C22:5 | C22:6 |
|---|---|---|---|---|---|---|---|
| 5197 [13]-010.Sx001.008 | 1.28 | 0.38 | 0.02 | 0.04 | 0.20 | 0.12 | 0.28 |

TABLE 15-continued

Fatty acid composition of T$_2$ seed from event
Event 5197[13]-010.001 homozygous at locus A

| | | | | | | | |
|---|---|---|---|---|---|---|---|
| 5197 [13]-010.Sx001.015 | 1.07 | 0.32 | 0.02 | 0.04 | 0.16 | 0.12 | 0.31 |
| 5197 [13]-010.Sx001.050 | 0.99 | 0.28 | 0.03 | 0.05 | 0.13 | 0.33 | 0.70 |
| 5197 [13]-010.Sx001.051 | 1.11 | 0.34 | 0.02 | 0.04 | 0.15 | 0.18 | 0.41 |

Example 10

Field Production of DHA in Canola

The T$_2$ seed from ten homozygous lines of 5197[14]-032.002 that contained the highest levels of DHA were pooled to yield 60 μm of seed. Seed was also pooled from 10 null segregant lines to give 47 gm of seed for use as a negative control. The seed was planted at two locations in North Dakota in May 2009 with 8 plots of the transgene-containing seed, 6 plots of null segregant seed and two plots of a commercial control (Nexera 845CL) at each location. All of the transgenic plant plots and four of the null segregant plots were covered with isolation cages during flowering. The remaining two null plots and the Nexera 845CL plots were left uncovered. The plots were swathed and harvested in September according to normal practices. At Site 1, a plot average of 0.95 kg of seed was obtained from transgenic plants and 0.99 kg from the null plants. At Site 2, plot averages were 0.64 kg from transgenic plants and 0.73 kg from nulls. GC-FAME lipid analysis of seed from each plot was performed to determine the levels of LC-PUFAs in the field-grown seed (Table 16).

TABLE 16

T3 seed DHA content by 10-seed bulk analysis from field-grown T$_2$ plants of 5197[14]-032.002.

| Site | Plot | Average DHA content (% total FAMEs) | Average LC-PUFA content (% Total FAMEs) |
|---|---|---|---|
| Site 1 | 1-1 1 (homo) | 0.01% | 0.02% |
| Site 1 | 1-1 2 (homo) | 0.18% | 0.27% |
| Site 1 | 1-1 7 (homo) | 0.13% | 0.19% |
| Site 1 | 1-1 8 (homo) | 0.21% | 0.33% |
| Site 1 | 1-2 1 (homo) | 0.17% | 0.26% |
| Site 1 | 1-2 3 (homo) | 0.21% | 0.32% |
| Site 1 | 1-2 7 (homo) | 0.30% | 0.44% |
| Site 1 | 1-2 8 (homo) | 0.15% | 0.23% |
| Site 1 | 1-1 3 (sib null) | 0.00% | 0.00% |
| Site 1 | 1-1 5 (sib null) | 0.00% | 0.00% |
| Site 1 | 1-1 6 (sib null) | 0.00% | 0.00% |
| Site 1 | 1-2 2 (sib null) | 0.00% | 0.00% |
| Site 1 | 1-2 4 (sib null) | 0.00% | 0.00% |
| Site 1 | 1-2 6 (sib null) | 0.00% | 0.00% |
| Site 1 | 1-2 5_Nexera845 | 0.00% | 0.00% |
| Site 2 | 2-1 1 (homo) | 0.24% | 0.37% |
| Site 2 | 2-1 3 (homo) | 0.19% | 0.27% |
| Site 2 | 2-1 7 (homo) | 0.23% | 0.36% |
| Site 2 | 2-1 8 (homo) | 0.32% | 0.48% |
| Site 2 | 2-2 1 (homo) | 0.38% | 0.56% |
| Site 2 | 2-2 3 (homo) | 0.27% | 0.41% |
| Site 2 | 2-2 6 (homo) | 0.33% | 0.47% |
| Site 2 | 2-2 8 (homo) | 0.16% | 0.24% |
| Site 2 | 2-1 2 (sib null) | 0.00% | 0.00% |
| Site 2 | 2-1 4 (sib null) | 0.00% | 0.00% |
| Site 2 | 2-1 6 (sib null) | 0.00% | 0.00% |
| Site 2 | 2-2 2 (sib null) | 0.00% | 0.00% |
| Site 2 | 2-2 5 (sib null) | 0.00% | 0.00% |
| Site 2 | 2-2 7 (sib null) | 0.00% | 0.00% |
| Site 2 | 2-1 5_Nexera845 | 0.00% | 0.00% |

The results from Table 16 represent an analysis of three samples from each plot. Seed from plot 1-11 contained lower levels of 18:1 (65.5%) and higher levels of 18:3 (7.6%) compared to other Site 1 plots (average 76.7% 18:1 and 2.9% 18:3), and was therefore considered to be extensively contaminated with conventional canola. This plot was excluded from subsequent analyses. The average DHA content by 10-seed bulk analyses of the T$_3$ seed from the transgenic plants from Site 1 was 0.19% and from Site 2 was 0.26%. The highest DHA content was 0.38% (with 0.03% EPA). The average % ratio of n-3 LC-PUFA/Total PUFAs was 73%.

Samples of each T$_2$ line used in the field trial were also grown in the greenhouse. The average DHA content by 10-seed bulk analyses of the T$_3$ greenhouse seed was 0.22% with individual plants having up to 0.8% DHA. This correlates with the amount of DHA produced in the field.

These data show that the subject PUFA synthase gene suite can direct production of DHA under field conditions.

Example 11

DHA Gene Expression Analysis Using Microarray Technology

Developing canola seeds were collected from a transgenic homozygous Event 5197[14]-032.002 line and untransformed null plants at 15, 20, 25, 30, 35 and 42 days after pollination (DAP). A single-color global gene expression profiling design was used to determine the levels of expression of each of the newly introduced genes into the homozygous transformed line in relation to the untransformed null line for each of the defined time points during seed development. Three identical technical replicates of individual 60-mer oligo arrays (Agilent Technologies Inc., Santa Clara, Calif.) were hybridized with amplified, Cy3 labeled cRNA from each sample. A custom designed (eArray, Agilent Technologies Inc., Santa Clara, Calif.) 60-mer comprehensive transcriptome-wide canola oligonucleotide array was used to carry out the hybridizations previously described. This array contains more than 37,000 different canola transcripts (Agilent Technologies Inc., Santa Clara, Calif.) obtained from public data sources. To efficiently measure the expression levels of each transcript, the oligos present in the array were designed to be unique and specific for each target to efficiently hybridize with the predicted target sequence. Oligos that form a duplex with more than one transcript were eliminated from the array. Each oligo also fulfills the chemical and physical properties required for optimal performance throughout microarray processing. In addition, specific and unique oligos representing the newly introduced genes as well as several other genes of interest are also represented in the custom designed canola oligo array. The 60-mer oligos were synthesized in-situ using the Sure-Print technology from the manufacturer.

RNA Isolation and Purification

Samples of developing seeds from Event 5197[14]-032.002 and a null plant control were frozen and pooled to be used as starting material for RA isolation and purification. A total of 500 mgs of seed tissue per pooled sample were ground with liquid nitrogen using a mortar and pestle and approximately 50 mgs of the ground tissue were resuspended in 450 µl of extraction buffer RLT from the RNeasy Kit for RNA extraction (Qiagen, Valencia, Calif.). Samples were vortexed briefly to disrupt tissues before continuing with the extraction protocol. Total RNA was purified following the instructions from the RNeasy Kit for RNA extraction (Qiagen, Valencia, Calif.). Purified total RNA was then quantified using a NanoQuant (TECAN, Research Triangle Park, N.C.) spectrophotometer and visualized by standard 1% Agarose gel electrophoresis.

For labeling, a total of 1.0 µg of purified total RNA from each sample was reverse transcribed, amplified and labeled with Cy3-CTP following the Agilent (Santa Clara, Calif.) One-color microarray-based gene expression QuickAmp labeling protocol. Since each canola array contains more than 1300 internal spike-in controls a One-color RNA spike-in kit (Agilent, Santa Clara, Calif.) was also labeled according to manufacturer's instructions. Samples were reverse transcribed using MMLV Reverse Transcriptase and amplified using a T7 RNA Polymerase. After amplification cRNA was purified using Qiagen's RNeasy mini spin columns and quantified using a NanoQuant spectrophotometer (TECAN, Research Triangle Park, N.C.). Specific activity for Cy3 was determined by the following formula: (Concentration of Cy3/(Concentration of cRNA)*1000=pmol of Cy3 per µg of cRNA. Samples for hybridization were normalized to 1.65 µgs with a specific activity of >9.0 pmol of Cy3 per µg of cRNA.

Hybridization, Scanning and Feature Extraction

Oligo gene expression arrays were hybridized using the Agilent Technologies (Santa Clara, Calif.) Gene Expression Hybridization kit and Wash Buffer kit. Hybridizations were carried out on a fully automated TECAN HS4800 PRO (TECAN, Research Triangle Park, N.C.) hybridization station. The hybridization mixture was injected at 65° C. and incubated with agitation for 17 hrs after following a slide pre-hybridization step at 65° C. for 30 seconds. Slides were then washed at 37° C. for 1 minute using the Agilent GE Wash #1 followed by a second wash at 30° C. with Agilent GE Wash #2 for 1 minute and a final drying step using Nitrogen gas for 2 minutes and 30 seconds at 30° C. Slides were scanned immediately to minimize impact of environmental oxidants on signal intensities.

Arrays were scanned using an Agilent G2565CA microarray scanner with SureScan high resolution technology (Agilent Technologies, Santa Clara, Calif.). The protocol for scanning each array defines parameters for dye channel, scan region and resolution, TIFF file dynamic range, PMT gain and the setting for the final image outcome. Once the array has been scanned a feature extraction (FE) protocol is followed, using parameters defined for placing and optimizing the grid fit, finding the spots, flagging outliers, computing background bias, error and ratios, and calculating quality control metrics. After scanning and feature extraction protocols are completed, a TIFF file containing the Cy3 image is generated along with a quality control metrics report and a final file (TXT) containing all the raw data. The image files (TIFF) were used to examine general quality of the slides, presence of spike-in controls in the right positions (four corners) and intensities, as well as to confirm that hybridization, washing, scanning and feature extraction processes were successful. The FE quality control (QC) report provided values of coefficient of variation allowing to measure dispersion of data based on positive and negative (prokaryotic genes and artificial sequences) spike-in controls provided and designed by Agilent Technologies (Santa Clara, Calif.). This report also provided information about data distribution, uniformity, background, reproducibility, sensitivity and general quality of data. The TXT file containing all the raw data was uploaded into GeneSpring (Agilent, Santa Clara, Calif.) for further analysis.

Data Normalization and Statistical Analysis

After scanning and feature extraction, raw data files were uploaded into GeneSpring GX version 10.0.2 (Agilent Technologies, Santa Clara, Calif.) and a project was created defining each array data file as a sample and assigning the appropriate parameter values. Samples with the same parameter values were treated as replicates. Interpretations were created to specify how the samples were grouped into experimental conditions and were used to visualize and analyze data. Quality control on samples based on spike-in controls, parameters and interpretations previously defined, was performed to ensure quality of data before starting analysis and a quality control metrics report by GeneSpring was generated.

Data was normalized using a global percentile shift normalization method to minimize systematic non-biological differences and standardize arrays for cross comparisons. This algorithm transformed signal intensities to log base 2 and arranged them in increasing order, computing the rank of the $75^{th}$ percentile and subtracting this value from each of the log transformed signal intensities generating the normalized intensity value. Data was filtered by selecting entities that were flagged as Present in every single sample under study and eliminating entities flagged as Marginal or Absent. The filtered and normalized list of entities was used as input for statistical analysis using a Two Way ANOVA method with a corrected p-value cut-off of $p<0.05$ defining DAP and Genotype as parameters. The expression profile for each of the newly introduced genes was determined.

Results

The values obtained for concentration of total RNA as well as labeled and amplified cRNA were optimal. Also the values for concentration after amplification, efficiency of labeling with Cy3 and specific activity required for consistent and reliable results were excellent. The quality control (QC) report provided by the feature extraction protocol for each individual array after scanning provided values of coefficient of variation that were used to measure dispersion of data based on positive and negative spike-in controls. All the values obtained from the reports showed optimal quality of data distribution, uniformity, background and sensitivity. The GeneSpring (Agilent Technologies, Santa Clara, Calif.) quality control metrics report on samples used during this study provided significant statistical values that assisted in the evaluation of reproducibility and reliability of the data obtained. The reported values for the groups of technically replicated arrays (3 per sample) were within range and indicated that the data obtained was reliable (Data not shown).

The raw values reported for each of the six time points defined during seed development for the homozygote (Table 17) ("DAP" represents days after pollination) and null (Table 18) lines represent the signal intensity values left after all the feature extraction (FE) processing steps have been completed including background subtraction and multiplicative detrending when necessary. Normalized values for homozygote (Table 19) and null (Table 20) lines on the other hand, have been processed using a global percentile shift normalization method that accounts for technical variation, minimizes systematic non-biological differences and standardizes arrays for cross comparisons.

TABLE 17

Raw intensity values of expression for each of the newly introduced genes in the homozygote Event 5197[14]-032.002.

| Oligo ID | Contig_ID | 15 DAP | 20 DAP | 25 DAP | 30 DAP | 35 DAP | 42 DAP |
|---|---|---|---|---|---|---|---|
| BnOL1037472 | SzPUFA_OrfA_v2 | 550.5884 | 1555.393 | 10616.878 | 55336.754 | 53827.918 | 168238.69 |
| BnOL1037031 | SzACS-2_v3 | 735.7014 | 7502.7305 | 53598.45 | 160619.44 | 125797.09 | 149734.28 |
| BnOL1037030 | hSzThPUFA_OrfC_v3 | 278.55338 | 6337.2075 | 41672.094 | 101111.23 | 65916.695 | 79815.85 |
| BnOL1037032 | NoHetl_v3 | 438.25513 | 2608.736 | 22412.197 | 84830.35 | 72039.04 | 81936.24 |
| BnOL1037029 | SzPUFA_OrfB_v3 | 20.972246 | 319.27515 | 3329.6416 | 8812.985 | 4742.8223 | 9504.665 |
| BnOL1037034 | PAT_v5 | 1433.2236 | 3672.4446 | 6221.7075 | 6744.2925 | 1784.8667 | 5964.65 |

TABLE 18

Raw intensity values of expression for each of the newly introduced genes in the null untransformed Omega-9 Nexera 710 line.

| Oligo ID | Contig_ID | 15 DAP | 20 DAP | 25 DAP | 30 DAP) | 35 DAP | 42 DAP |
|---|---|---|---|---|---|---|---|
| BnOL1037472 | SzPUFA_OrfA_v2 | 24.637857 | 13.909026 | 18.128113 | 17.591684 | 21.86625 | 22.927202 |
| BnOL1037031 | SzACS-2_v3 | 4.892006 | 1.9428447 | 4.488978 | 4.234072 | 33.388905 | 5.6000123 |
| BnOL1037030 | hSzThPUFA_OrfC_v3 | 19.027159 | 14.894593 | 24.208069 | 20.789322 | 20.698792 | 16.794432 |
| BnOL1037032 | NoHetl_v3 | 3.1428213 | 1.9340261 | 4.188954 | 3.1923647 | 17.189857 | 4.665717 |
| BnOL1037029 | SzPUFA_OrfB_v3 | 2.3353922 | 3.9272563 | 6.6409183 | 3.3479385 | 3.8365993 | 32.812595 |
| BnOL1037034 | PAT_v5 | 3.3936017 | 2.7436378 | 4.193728 | 35.491924 | 11.871919 | 27.160715 |

TABLE 19

Normalized intensity values of expression for each of the newly introduced genes in the homozygote Event 5197[14]-032.002.

| Oligo ID | Contig_ID | 15 DAP | 20 DAP | 25 DAP | 30 DAP | 35 DAP | 42 DAP |
|---|---|---|---|---|---|---|---|
| BnOL1037472 | SzPUFA_OrfA_v2 | 1.7016697 | 3.3545377 | 6.0190024 | 8.880801 | 9.054455 | 11.272922 |
| BnOL1037031 | SzACS-2_v3 | 1.8789514 | 5.3857155 | 8.116115 | 10.176245 | 10.039913 | 10.870583 |
| BnOL1037030 | hSzThPUFA_OrfC_v3 | 1.4449383 | 6.1070085 | 8.718198 | 10.475076 | 10.072738 | 10.922383 |
| BnOL1037032 | NoHetl_v3 | 1.887683 | 4.618933 | 7.613214 | 10.01268 | 9.989469 | 10.756434 |
| BnOL1037029 | SzPUFA_OrfB_v3 | −0.7546156 | 3.3309612 | 6.6095963 | 8.492256 | 7.811666 | 9.391258 |
| BnOL1037034 | PAT_v5 | 1.9656178 | 3.4748821 | 4.1320724 | 4.72564 | 3.0201833 | 5.337647 |

TABLE 20

Normalized intensity values of expression for each of the newly introducted genes in the null untransformed Omega-9 Nexera 710 line.

| Oligo ID | Contig_ID | 15 DAP | 20 DAP | 25 DAP | 30 DAP | 35 DAP | 42 DAP |
|---|---|---|---|---|---|---|---|
| BnOL1037472 | SzPUFA_OrfA_v2 | −2.6522558 | −3.253315 | −3.0071614 | −2.8780248 | −2.3888729 | −2.038585 |
| BnOL1037031 | SzACS-2_v3 | −5.3231525 | −6.39583 | −5.3554688 | −5.8499255 | −1.9909037 | −4.2954717 |
| BnOL1037030 | hSzThPUFA_OrfC_v3 | −2.3083773 | −2.42181 | −1.8761693 | −1.9263924 | −1.7606672 | −1.6746639 |
| BnOL1037032 | NoHetl_v3 | −5.2632127 | −5.647943 | −4.671536 | −5.151732 | −2.2263987 | −3.93217 |
| BnOL1037029 | SzPUFA_OrfB_v3 | −3.8752975 | −2.9589367 | −2.3685415 | −3.026766 | −2.905297 | 0.8310469 |
| BnOL1037034 | PAT_v5 | −6.7221875 | −6.835022 | −6.305078 | −3.753248 | −4.357948 | −2.8239324 |

Figure 12:
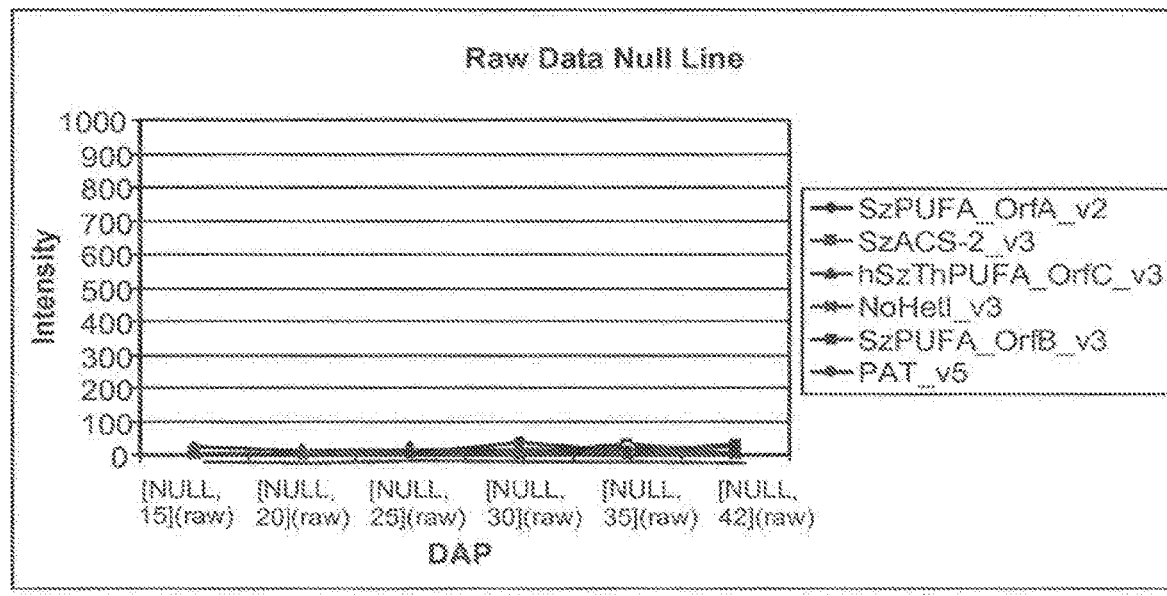
FIG. 12 shows expression profiles of genes of interest in the null untransformed Omega-9 Nexera 710 line using the raw intensity values for each of the 6 time points expressed as days after pollination (DAP).
Figure 13:
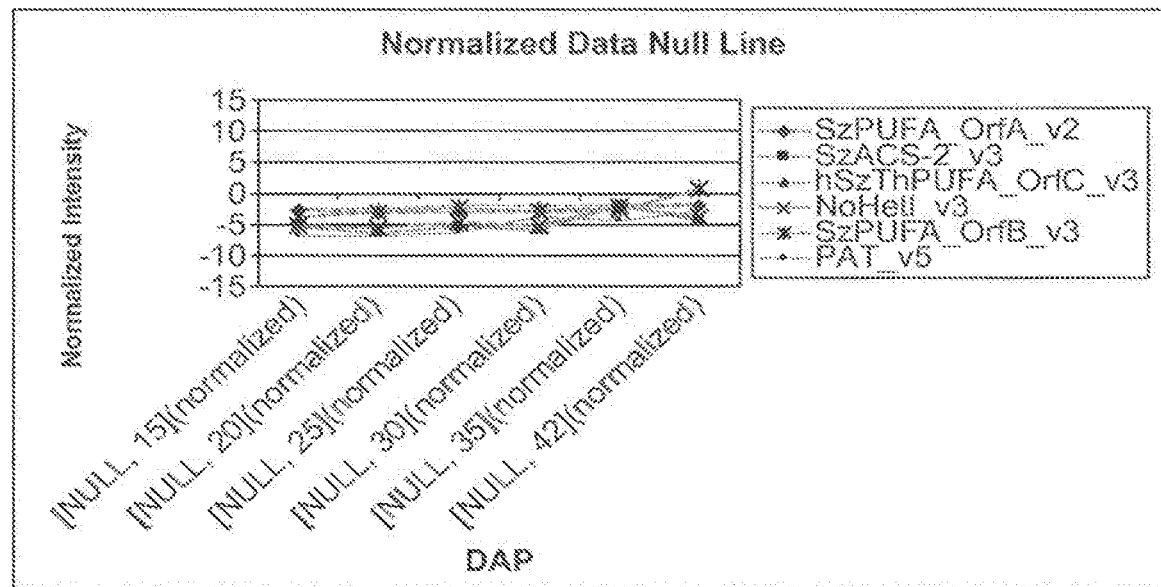
FIG. 13 shows expression profiles of genes of interest in the null untransformed Omega-9 Nexera 710 line using the normalized intensity values for each of the 6 time points expressed as DAP.
Figure 14:
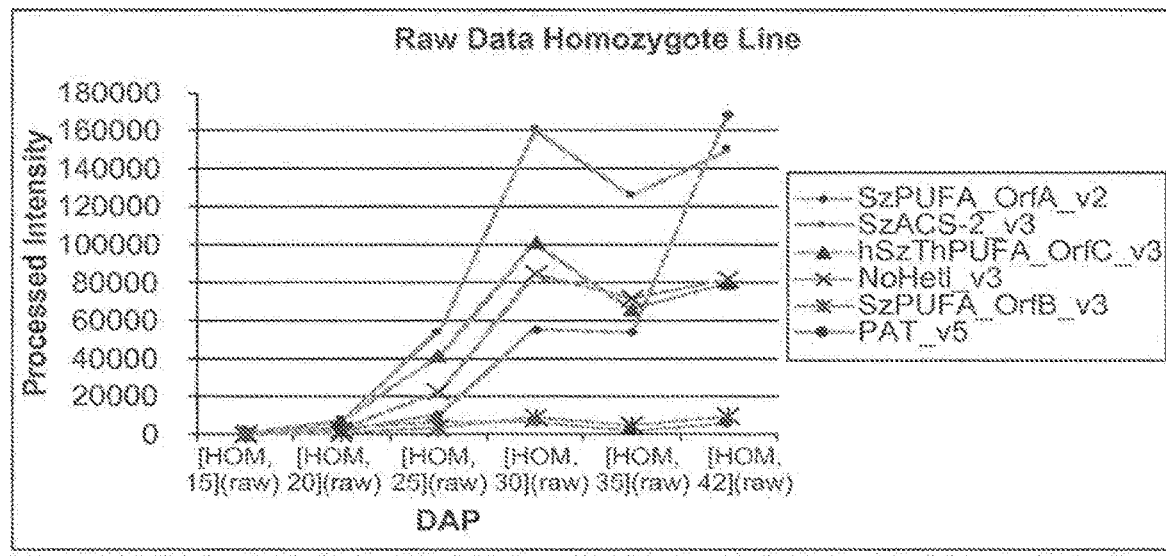
FIG. 14 shows expression profiles of genes of interest in the homozygote event 5197[14]-032.002 line using the raw intensity values for each of the 6 time points expressed as DAP.
Figure 15:
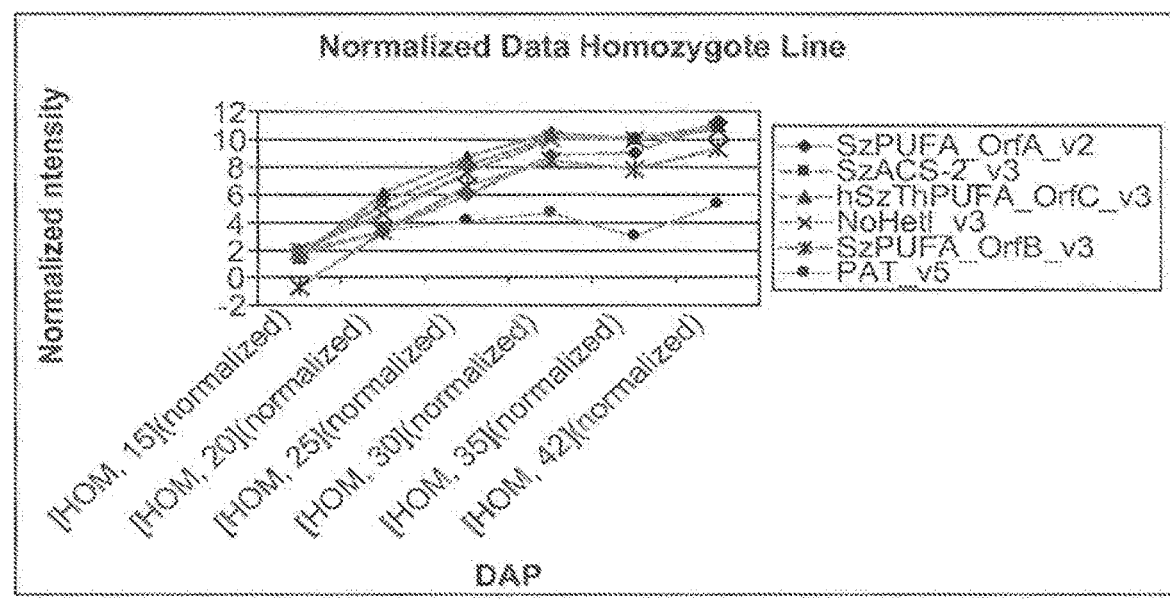
FIG. 15 shows expression profiles of genes of interest in the homozygote event 5197[14]-032.002 line using the normalized intensity values for each of the 6 time points expressed as DAP.

The schematic representation of the raw (FIG. 12) and normalized (FIG. 13) values obtained for the null line at every time point during seed development confirm that these genes are not present in the Omega-9 Nexera 710 untransformed line and therefore significant expression is not detected. In the Event 5197[14]-032.002 line as shown in FIG. 14 (raw) and FIG. 15 (normalized), a general trend of increasing transcript accumulation of all genes as seed development progresses can be observed. The initial significant increase of transcript accumulation occurs during 15 and 30 DAP and reaches maximum levels at DAP 42. The raw curves showed in FIG. 14, provide a visualization of the relative hybridization intensity values obtained for each of the genes under study, while the normalized curves summarized in FIG. 15 represent the general trend of gene expression profiles with minimized systematic non-biological variation and standardized comparisons across arrays.

Example 12

Expression of the Algal PUFA Synthase Gene Suite Using Alternative Promoters

The use of additional transcriptional regulatory elements to express the gene(s) encoding PUFA synthase OrfA, PUFA synthase OrfB, PUFA synthase chimeric OrfC, acyl-CoA synthetase and 4' phosphopantetheinyl transferase HetI proteins can further increase DHA content within canola. Identification and use of transcriptional regulatory elements which express earlier in development and for extended periods of time can increase the levels of DHA within canola seed by promoting transcription of a heterologous gene at earlier stages of seed development (e.g., at 15 to 25 DAP) and therefore extend the time of DHA production. Examples of such transcriptional regulatory regions include, but are not limited to, the LfKCS3 promoter (U.S. Pat. No. 7,253, 337) and FAE 1 promoter (U.S. Pat. No. 6,784,342) and the ACP promoter (WO 1992/18634). These promoters are used singularly or in combination to drive the expression of the PUFA synthase OrfA, PUFA synthase OrfB, PUFA synthase chimeric OrfC, acyl-CoA synthetase and 4' phosphopantetheinyl transferase HetI expression cassettes, which were previously described in the following plasmids; pDAB7361, pDAB7362, and pDAB7363. Methods to replace transcriptional regulatory regions within a plasmid are well known within the art. As such, a polynucleotide fragment comprising the PvDlec2 promoter v2 is removed from pDAB7361, pDAB7362, or pDAB7363 (or the preceding plasmids used to build pDAB7361, pDAB7362, or pDAB7363) and replaced with either LfKCS3 or the FAE 1 promoter regions. The newly constructed plasmids are used to stably transform canola plants. Transgenic canola plants are isolated and molecularly characterized. The resulting LC-PUFA accumulation is determined and canola plants which produce 0.01% to 15% DHA or 0.01% to 10% EPA are identified.

Construction of pDAB9166

Figure 26:
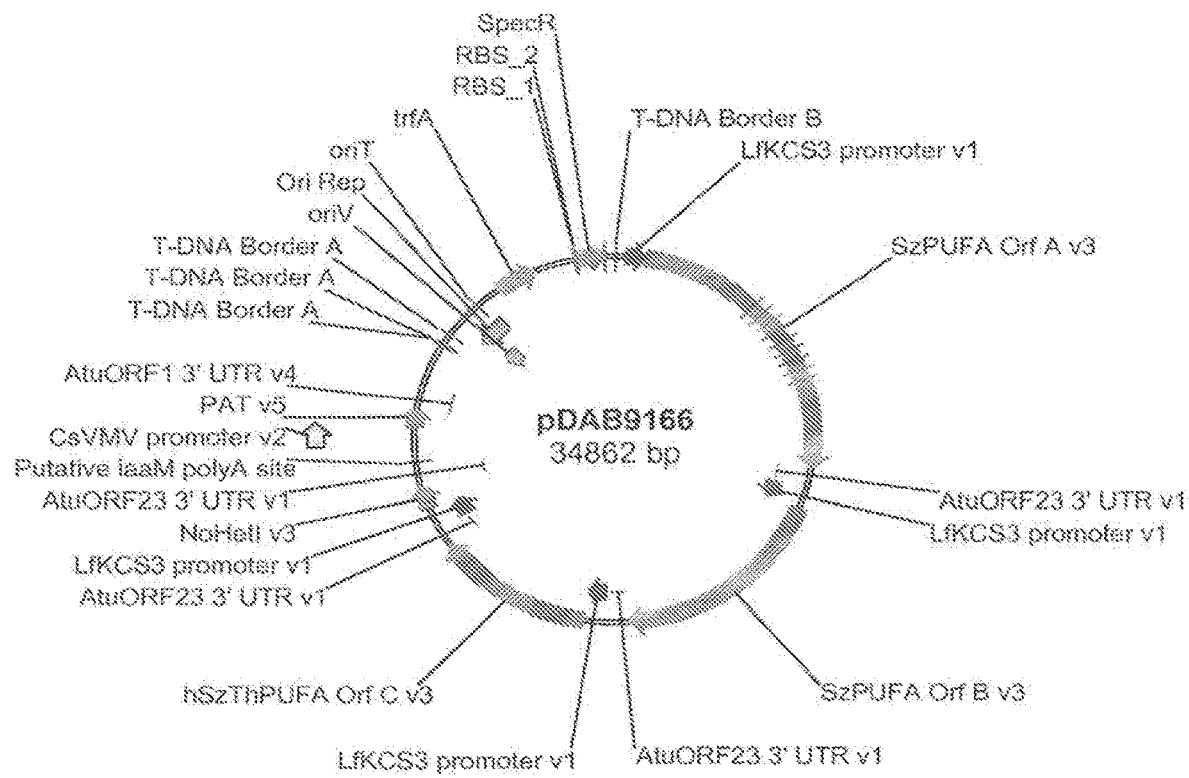
FIG. 26 shows the plasmid map of pDAB9166.

The pDAB9166 plasmid (FIG. 26; SEQ ID NO:46) was constructed using a multi site Gateway L-R recombination reaction. pDAB9166 contains three PUFA synthase PTUs, one phosphopantetheinyl transferase PTU and a phosphinothricin acetyl transferase PTU. Specifically, the first PUFA synthase PTU contains the LfKCS3 promoter v1, SzPUFA OrfA v3 and AtuORF23 3' UTR v1. The second PUFA synthase PTU contains the LfKCS3 promoter v1, SzPUFA OrfB v3 and AtuOrf23 3' UTR v1. The third PUFA synthase PTU contains the LfKCS3 promoter v1, hSzThPUFA OrfC v3 and AtuORF23 3' UTR v1. The phosphopantetheinyl transferase PTU contains the LfKCS3 promoter v1, NoHetI v3 and AtuORF23 3' UTR v1.

Plasmids pDAB9161, pDAB9162, pDAB9163, pDAB101484 and pDAB7333 were recombined to form pDAB9166. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Construction of pDAB9167

Figure 27:
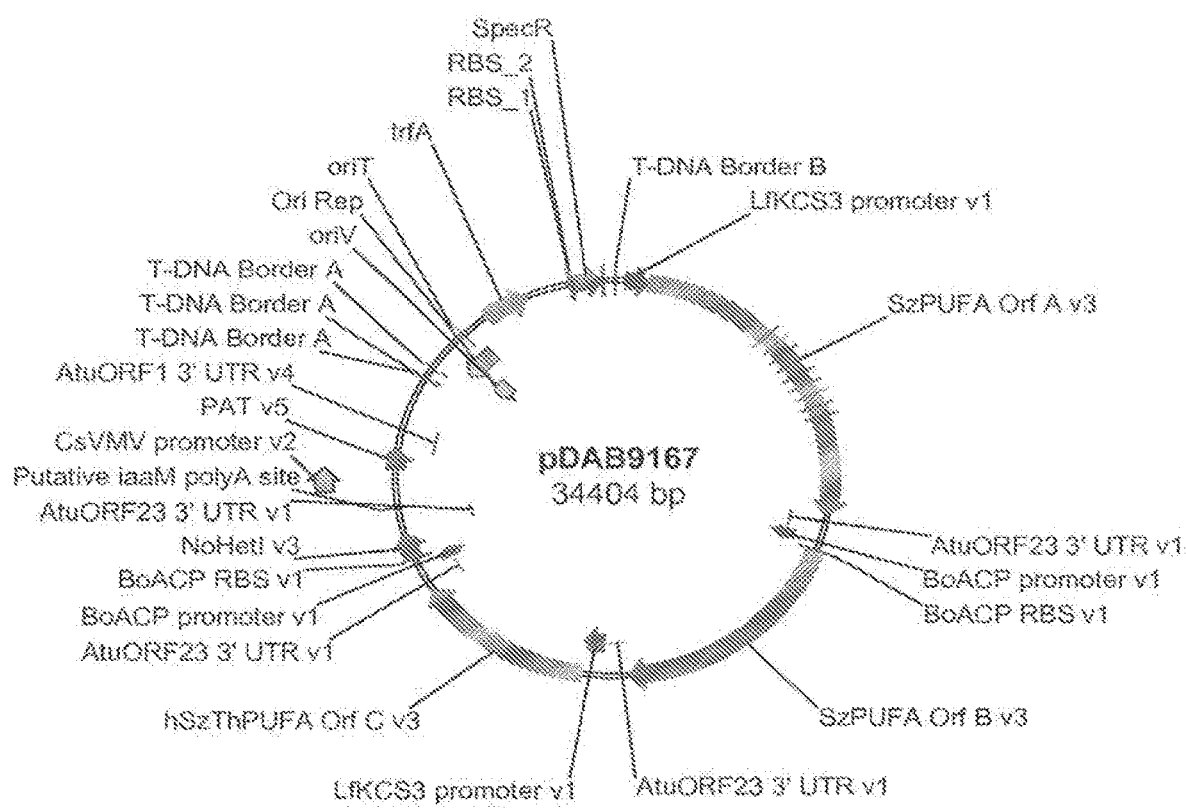
FIG. 27 shows the plasmid map of pDAB9167.

The pDAB9167 plasmid (FIG. 27; SEQ ID NO:47) was constructed using a multi-site Gateway L-R recombination reaction. pDAB9167 contains three PUFA synthase PTUs, one phosphopantetheinyl transferase PTU and a phosphinothricin acetyl transferase PTU. Specifically, the first PUFA synthase PTU contains the LfKCS3 promoter v1, SzPUrA OrfA v3 and AtuORF23 3' UTR v1. The second PUFA synthase PTU contains the BoACP promoter v1, BoACP 5' UTR v1, SzPUFA OrfB v3 and AtuOrf23 3' UTR v1. The third PUFA synthase PTU contains the LfKCS3 promoter v1, hSzThPUFA OrfC v3 and AtuORF23 3' UTR v1. The phosphopantetheinyl transferase PTU contains the BoACP promoter v1, BoACP 5' UTR v1, NoHetI v3 and AtuORF23 3' UTR v1.

Plasmids pDAB9161, pDAB9165, pDAB9163, pDAB101485 and pDAB7333 were recombined to form pDAB9167. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Figure 28:
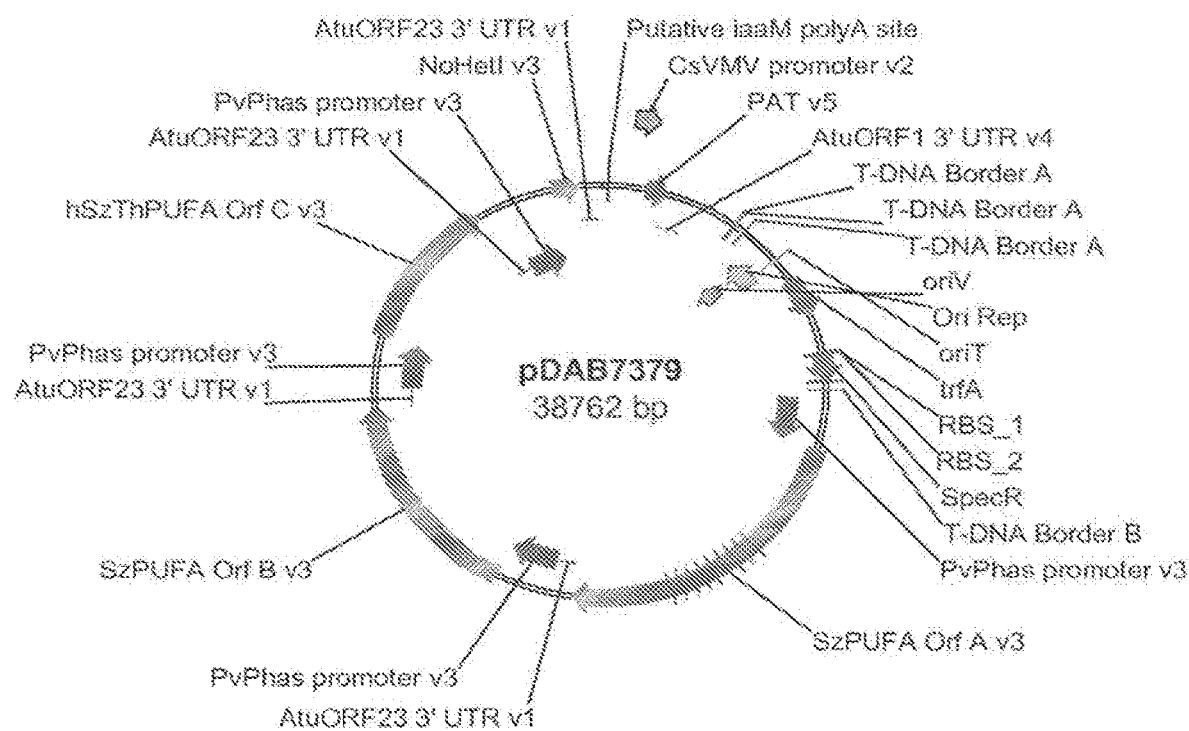
FIG. 28 shows the plasmid map of pDAB7379.

Construction of pDABD7379 pDAB7379 is a binary plasmid that was constructed to contain rebuilt, codon optimized versions of SzPUFA OrfA, SzPUFA OrfB, hSzThPUFA OrfC, and NoHetI. The SzACS-2 gene sequence is not included in this construct. The pDAB7379 plasmid (FIG. 28; SEQ ID NO:48) was constructed using a multi-site Gateway L-R recombination reaction.

pDAB7379 contains three PUFA synthase PTUs, one phosphopantetheinyl transferase PTU and a phosphinothricin acetyl transferase PTU. Specifically, the first PUFA synthase PTU contains the PvPhas Promoter v3, PvPhas 5' UTR, SzPUFA OrfA v3 and AtuORF23 3' UTR v1. The second PUFA synthase PTU contains the PvPhas Promoter v3, PvPhas 5' UTR, SzPUFA OrfB v3 and AtuORF23 3' UTR v1. The third PUFA synthase PTU contains the PvPhas Promoter v3, PvPhas 5' UTR, hSzThPUFA OrfC v3 and AtuORF23 3' UTR v1. The phosphopantetheinyl transferase PTU contains the PvPhas Promoter v3, PvPhas 5' UTR, NoHetI v3 and AtuORF23 3' UTR v1.

Plasmids pDAB7371, pDAB7372, pDAB7373, pDAB7374 and pDAB7333 were recombined to form pDAB7379. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Figure 29:
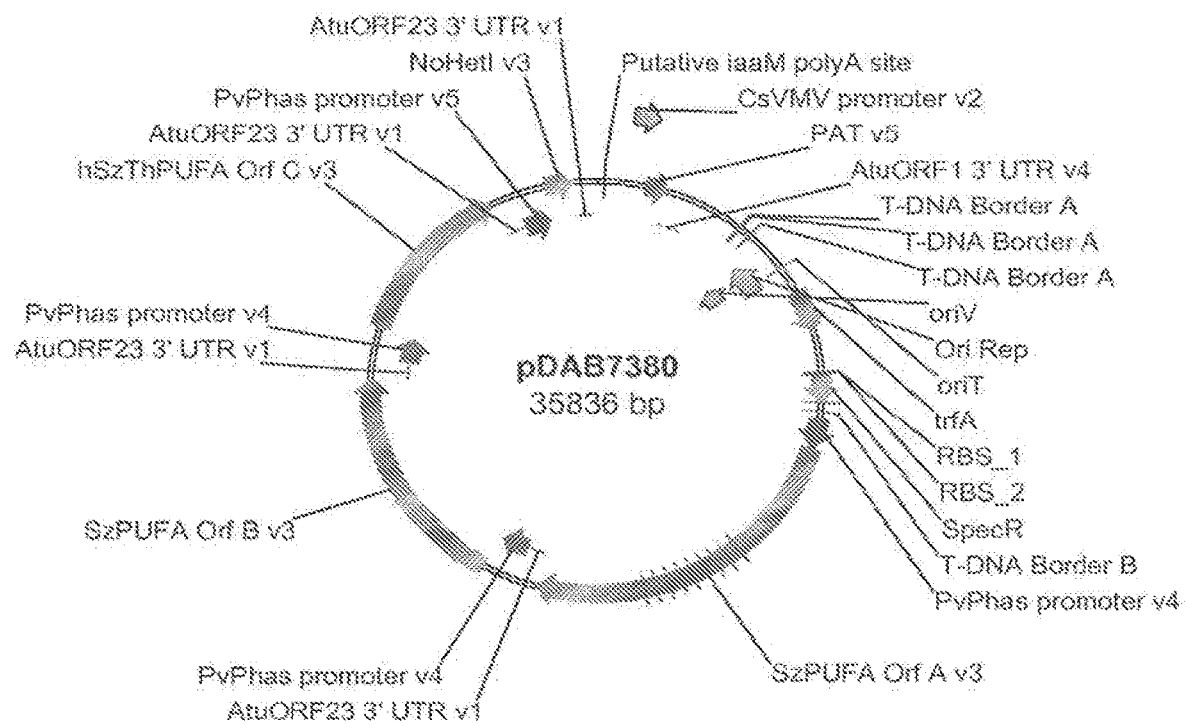
FIG. 29 shows the plasmid map of pDAB7380.

Construction, of pDAB7380 pDAB7380 is a binary plasmid that was constructed to contain rebuilt, codon optimized versions of SzPUFA OrfA, SzPUFA OrfB, hSzThPUFA OrfC, and NoHetI. The SzACS-2 gene sequence is not contained in this construct. The version of the phaseolin promoter used in this construct was modified essentially as described in Bustos et al., 1989 (The Plant Cell, Vol. 1; 839-853), wherein the 5' portion of the promoter was truncated and the phaseolin 5' untranslated region was left intact. The pDAB7380 plasmid (FIG. 29; SEQ ID NO:49) was constructed using a multi-site Gateway L-R recombination reaction.

pDAB7380 contains three PUFA synthase PTUs, one phosphopantetheinyl transferase PTU and a phosphinothricin acetyl transferase PTU. Specifically, the first PUFA synthase PTU contains the PvPhas Promoter v4, PvPhas 5' UTR, SzPUFA OrfA v3 and AtuORF23 3' UTR v1. The second PUFA synthase PTU contains the PvPhas Promoter v4, PvPhas 5' UTR, SzPUFA OrfB v3 and AtuORF23 3' UTR v1. The third PUFA synthase PTU contains the PvPhas Promoter v4, PvPhas 5' UTR, hSzThPUFA OrfC v3 and AtuORF23 3' UTR v1. The phosphopantetheinyl transferase PTU contains the PvPhas Promoter v5, PvPhas 5' UTR, NoHetI v3 and AtuORF23 3' UTR v1.

Plasmids pDAB7375, pDAB7376, pDAB7377, pDAB7378 and pDAB7333 were recombined to form pDAB7380. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Figure 30:
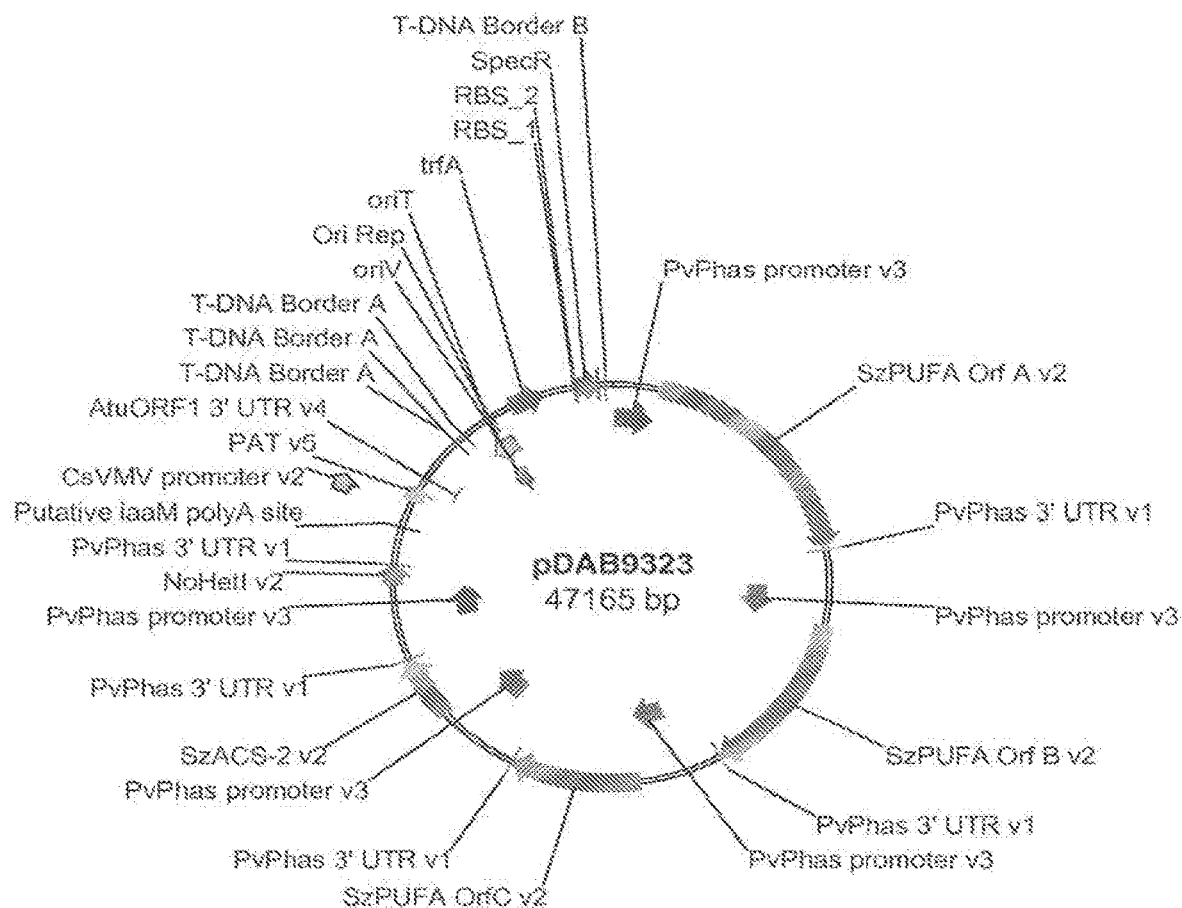
FIG. 30 shows the plasmid map of pDAB9323.

Construction of pDAB9323 pDAB9323 is a binary plasmid that was constructed to contain native, non-codon optimized versions of SzPUFA OrfA, SzPUFA OrfB, hSzThPUFA OrfC, SzACS-2, and NoHetI. The pDAB9323 plasmid (FIG. 30; SEQ ID NO:50) was constructed using a multi-site Gateway L-R recombination reaction.

pDAB9323 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvPhas Promoter v3, PvPhas 5' UTR, SzPUFA OrfA v2, PvPhas 3' UTR v1 and PvPhas 3' MAR v2 (unannotated on the plasmid map). The second PUFA synthase PTU contains the PvPhas Promoter v3, PvPhas 5' UTR, SzPUFA OrfB v2, PvPhas 3' UTR v1 and PvPhas 3' MAR v2 (unannotated on the plasmid map). The third PUFA synthase PTU contains the PvPhas Promoter v3, PvPhas 5' UTR, SzPUFA OrfC v2, PvPhas 3' UTR v1 and PvPhas 3' MAR v2 (unannotated on the plasmid map). The acyl-CoA synthetase PTU contains the PvPhas Promoter v3, PvPhas 5' UTR, SzACS-2 v2 gene, PvPhas 3' UTR v1 and PvPhas 3' MAR v2 (unannotated on the plasmid map). The phosphopantetheinyl transferase PTU contains the PvPhas Promoter v3, PvPhas 5' UTR, NoHetI v2, PvPhas 3' UTR v1 and PvPhas 3' MAR v2 (unannotated on the plasmid map).

Plasmids pDAB9307, pDAB9311, pDAB9315, pDAB9322 and pDAB7333 were recombined to form pDAB9323. Specifically, the five PTUs described above were placed in a head-to-tail orientation within the T-strand DNA border regions of the plant transformation binary pDAB7333. The order of the genes is: SzPUFA OrfA v2, SzPUFA OrfB v2, SzPUFA OrfC v2, NoHetI v2. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the six PTUs were then isolated and tested for incorporation of the six PTUs with restriction enzyme digestion and DNA sequencing.

Figure 31:
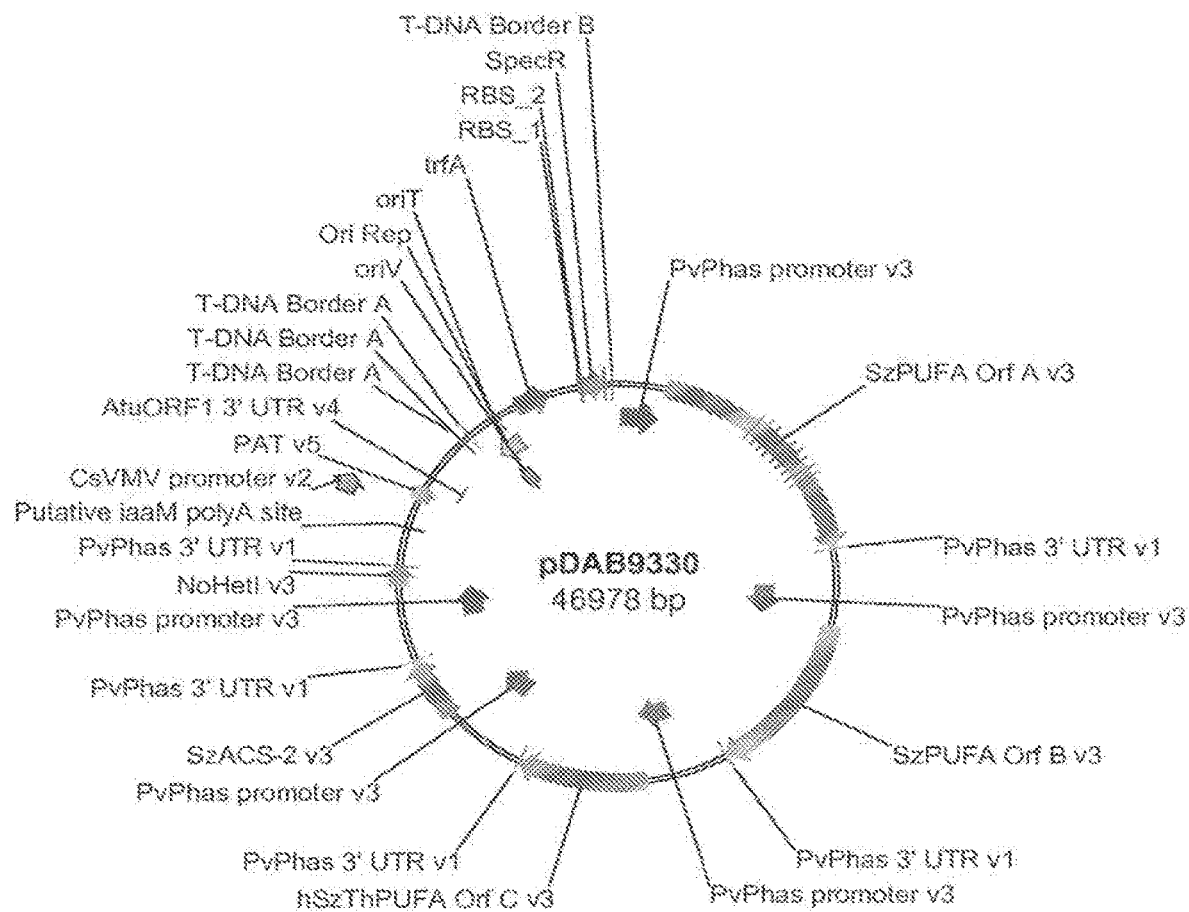
FIG. 31 shows the plasmid map of pDAB9330.

Construction of pDAB9330 pDAB9330 is a binary plasmid that was constructed to contain rebuilt, codon optimized versions of SzPUFA OrfA, SzPUFA OrfB, hSzThPUFA OrfC, SzACS-2, and NoHetI. The pDAB9330 plasmid (FIG. 31; SEQ ID NO:51) was constructed using a multi-site Gateway L-R recombination reaction. pDAB9330 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvPhas Promoter v3, PvPhas 5' UTR, SzPUFA OrfA v3, PvPhas 3' UTR v1 and PvPhas 3' MAR v2 (unannotated on the plasmid map). The second PUFA synthase PTU contains the PvPhas Promoter v3, PvPhas 5' UTR, SzPUFA OrfB v3, PvPhas 3' UTR and PvPhas 3' MAR v2 (unannotated on the plasmid map). The third PUFA synthase PTU contains the PvPhas Promoter v3, PvPhas 5' UTR, hSzThPUFA OrfC v3, PvPhas 3' UTR v1 and PvPhas 3' MAR v2 (unannotated on the plasmid map). The acyl-CoA synthetase PTU contains the PvPhas Promoter v3, PvPhas 5' UTR, SzACS-2 v3 gene, PvPhas 3' UTR v1 and PvPhas 3' MAR v2 (unannotated on the plasmid map). The phosphopantetheinyl transferase PTU contains the PvPhas Promoter v3, PvPhas 5' UTR, NoHetI v3, PvPhas 3' UTR v1 and PvPhas 3' MAR v2 (unannotated on the plasmid map).

Plasmids pDAB9324, pDAB9325, pDAB9326, pDAB9329 and pDAB7333 were recombined to form pDAB9330. Specifically, the five PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, SzACS-2 v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the six PTUs were then isolated and tested for incorporation of the six PTUs with restriction enzyme digestion and DNA sequencing.

Figure 32:
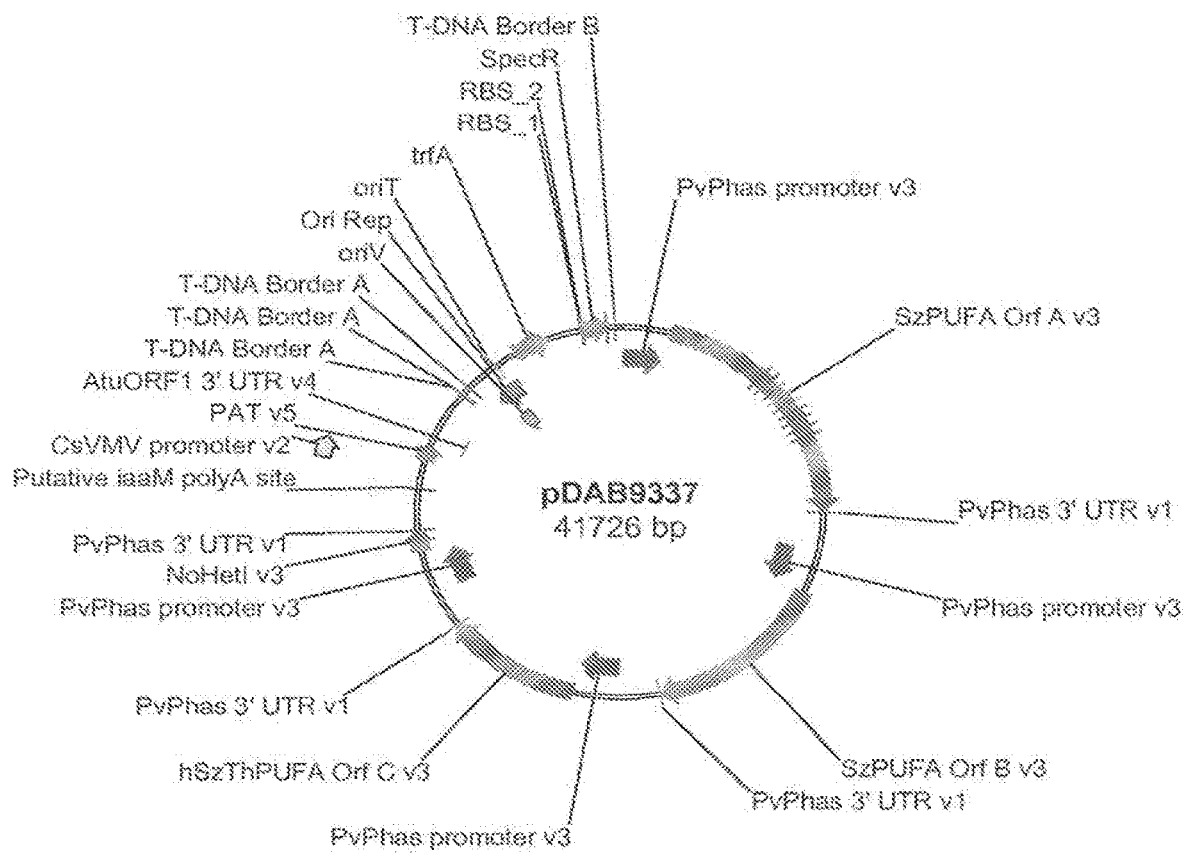
FIG. 32 shows the plasmid map of pDAB9337.

Construction of pDAB9337 pDAB9337 is a binary plasmid that was constructed to contain rebuilt, codon optimized versions of SzPUFA OrfA, SzPUFA OrfB, hSzThPUFA OrfC, and NoHetI expression of which is driven by the phaseolin promoter. The pDAB9337 plasmid (FIG. 32; SEQ ID NO:52) was constructed using a multi-site Gateway L-R recombination reaction.

pDAB9337 contains three PUFA synthase PTUs, one phosphopantetheinyl transferase PTU and a phosphinothricin acetyl transferase PTU. Specifically, the first PUFA synthase PTU contains the PvPhas Promoter v3, PvPhas 5' UTR, SzPUFA OrfA v3, PvPhas 3' UTR v1 and PvPhas 3' MAR v2 (unannotated on the plasmid map). The second PUFA synthase PTU contains the PvPhas Promoter v3, PvPhas 5' UTR, SzPUFA OrfB v3, PvPhas 3' UTR v1 and PvPhas 3' MAR v2 (unannotated on the plasmid map). The third PUFA synthase PTU contains the PvPhas Promoter v3, PvPhas 5' UTR, hSzThPUFA OrfC v3, PvPhas 3' UTR v1 and PvPhas 3' MAR v2 (unannotated on the plasmid map). The phosphopantetheinyl transferase PTU contains the PvPhas Promoter v3, PvPhas 5' UTR, NoHetI v3, PvPhas 3' UTR v1 and PvPhas 3' MAR v2 (unannotated on the plasmid map).

Plasmids pDAB9324, pDAB9325, pDA139326, pDAB9328 and pDAB7333 were recombined to form pDAB9337. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Figure 33:
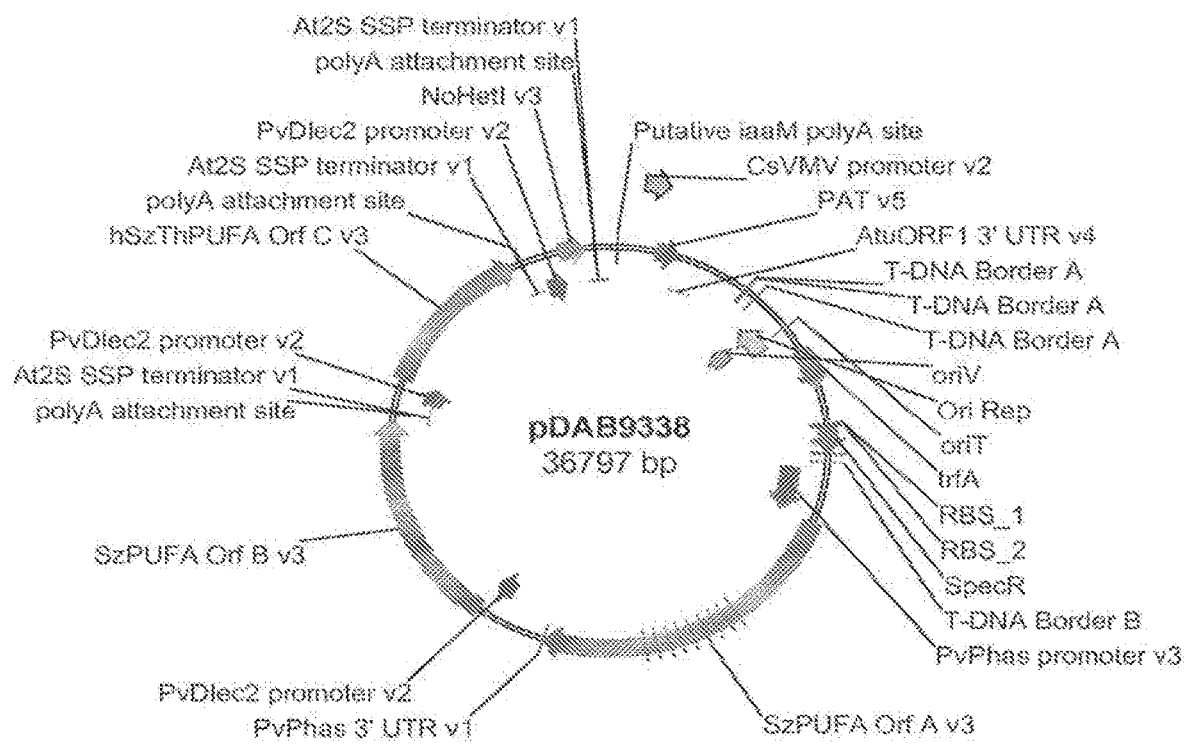
FIG. 33 shows the plasmid map of pDAB9338.

Construction of pDAB9338 pDAB9338 is a binary plasmid that was constructed to contain rebuilt, codon optimized versions of SzPUFA OrfA, SzPUFA OrfB, hSzThPUFA OrfC, and NoHetI. The phaseolin promoter is used to drive expression of SzPUFA OrfA, and PvDlec2 promoter is used to drive the other transgenes. The pDAB9338 plasmid (FIG. 33; SEQ ID NO:53) was constructed using a multi-site Gateway L-R recombination reaction.

pDAB9338 contains three PUFA synthase PTUs, one phosphopantetheinyl transferase PTU and a phosphinothricin acetyl transferase PTU. Specifically, the first PUFA synthase PTU contains the PvPhas Promoter v3, PvPhas 5' UTR, SzPUFA OrfA v3, PvPhas 3' UTR v1 and PvPhas 3' MAR v2 (unannotated on the plasmid map). The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The phosphopantetheinyl transferase PTU contains the PvDlec2 promoter v2, 2S 5' UTR, NoHetI v3 and At2S SSP terminator v1.

Plasmids pDAB9324, pDAB7335, pDAB7336, pDAB7338 and pDAB7333 were recombined to form pDAB9338. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Construction of pDAB9344 pDAB9344 is a binary plasmid that was constructed to contain rebuilt, codon optimized versions of SzPUFA OrfA, SzPUFA OrfB, hSzThPUFA OrfC, and NoHetI all of which contain the Ribulose Bisphosphate Carboxylase small chain 1A (labeled as SSU-TP v1) which is fused to the amino terminus of the coding sequence. The phaseolin promoter is used to drive expression of SzPUFA OrfA, and PvDlec2 promoter is used to drive the other transgenes.

Figure 34:
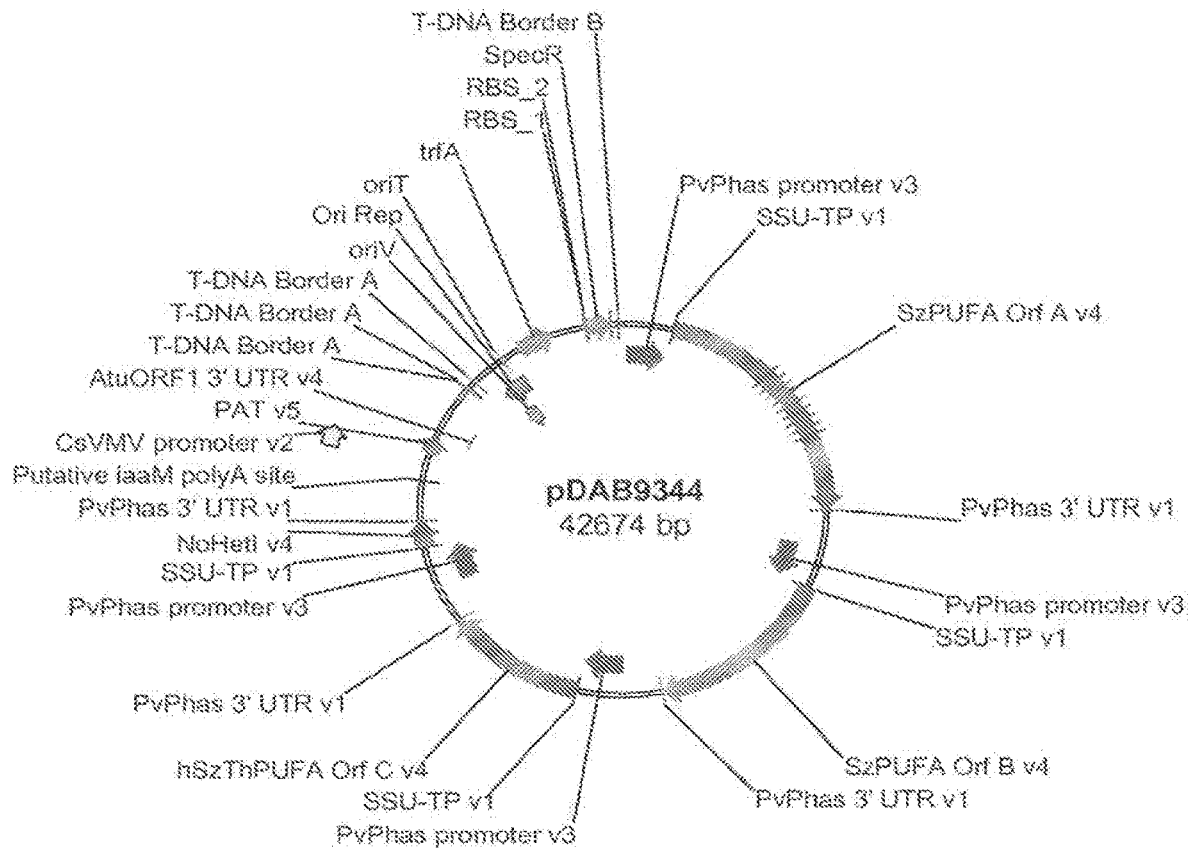
FIG. 34 shows the plasmid map of pDAB9344.

The pDAB9344 plasmid (FIG. 34; SEQ ID NO:54) was constructed using a multi-site Gateway L-R recombination reaction. pDAB9344 contains three PUFA synthase PTUs, one phosphopantetheinyl transferase PTU and a phosphinothricin acetyl transferase PTU. Specifically, the first PUFA synthase PTU contains the PvPhas Promoter v3, PvPhas 5' UTR, SzPUFA OrfA v4, PvPhas 3' UTR v1 and PvPhas 3' MAR v2 (unannotated on the plasmid map). The second PUFA synthase PTU contains the PvPhas Promoter v3, PvPhas 5' UTR, SzPUFA OrfB v4, PvPhas 3' UTR v1 and PvPhas 3' MAR v2 (unannotated on the plasmid map). The third PUFA synthase PTU contains the PvPhas Promoter v3, PvPhas 5' UTR, hSzThPUFA OrfC v4, PvPhas 3' UTR v1 and PvPhas 3' MAR v2 (unannotated on the plasmid map). The phosphopantetheinyl transferase PTU contains the PvPhas Promoter v3, PvPhas 5' UTR, NoHetI v4, PvPhas 3' UTR v1 and PvPhas 3' MAR v2 (unannotated on the plasmid map).

Plasmids pDAB9343, pDAB9342, pDAB9340, pDAB9331 and pDAB7333 were recombined to form pDAB9344. Specifically, the four PTUs described above were placed in a head-to-tail orientation within the T-strand DNA border regions of the plant transformation binary pDAB7333. The order of the genes is: SzPUFA OrfA v4, SzPUFA OrfB v4, hSzThPUFA OrfC v4, NoHetI v4, pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the six PTUs were then isolated and tested for incorporation of the five PTUs with restriction enzyme digestion and DNA sequencing.

Construction of pDAB9396 pDAB9396 is a binary plasmid that was constructed to contain rebuilt, codon optimized versions of SzPUFA OrfA, SzPUFA OrfB, hSzThPUFA OrfC, SzACS-2, and NoHetI. The phaseolin promoter is used to drive expression of SzPUFA OrfA and SzPUFA OrfB. The PvDlec2 promoter is used to drive the other transgenes; hSzThPUFA OrfC, SzACS-2, and NoHetI.

Figure 35:
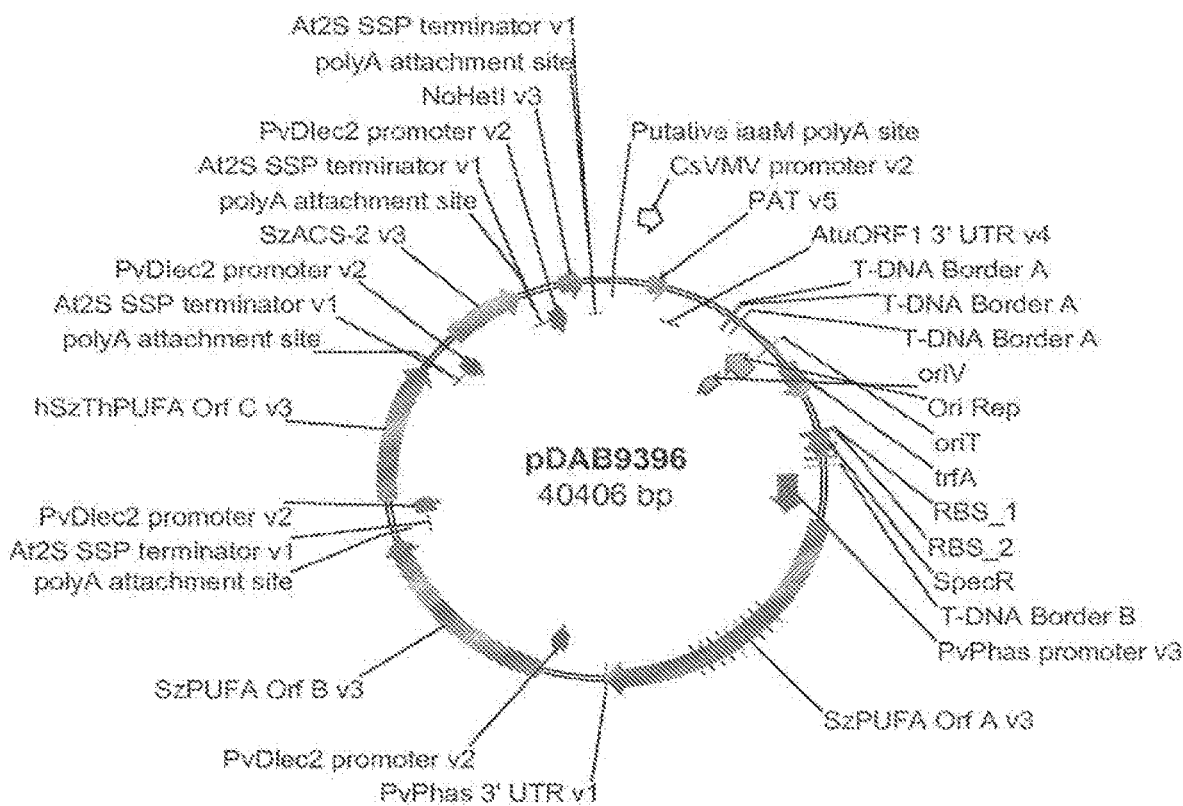
FIG. 35 shows the plasmid map of pDAB9396.

The pDAB9396 plasmid (FIG. 35; SEQ ID NO:55) was constructed using a multi-site Gateway L-R recombination reaction. pDAB9396 contains three PUFA synthase PTUs, one phosphopantetheinyl transferase PTU and a phosphinothricin acetyl transferase PTU. Specifically, the first PUFA synthase PTU contains the PvPhas Promoter v3, PvPhas 5' UTR, SzPUFA OrfA v3, PvPhas 3' UTR v1 and PvPhas 3' MAR v2 (unannotated on the plasmid map). The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The acyl-CoA synthetase PTU contains the PvPhas Promoter v3, PvPhas 5' UTR, SzACS-2 v3 gene, PvPhas 3' UTR v1 and PvPhas 3' MAR v2 (unannotated on the plasmid map). The phosphopantetheinyl transferase PTU contains the PvDlec2 promoter v2, 2S 5' UTR, NoHetI v3 and At2S SSP terminator v1.

Plasmids pDAB9324, pDAB7335, pDAB7336, pDAB7339 and pDAB7333 were recombined to form pDAB9338. Specifically, the five PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, SzACS-2 v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the six PTUs with restriction enzyme digestion and DNA sequencing.

Figure 36:
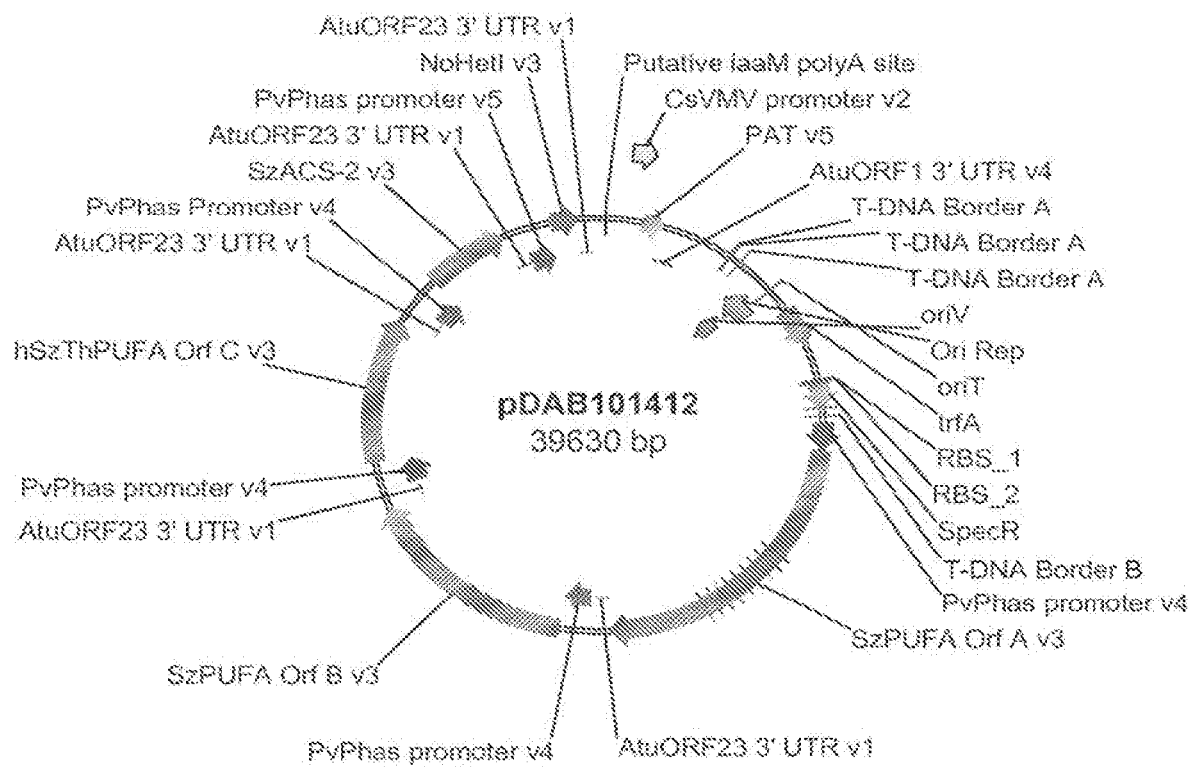
FIG. 36 shows the plasmid map of pDAB101412.

Construction of pDAB101412 pDAB101412 is a binary plasmid that was constructed to contain rebuilt, codon optimized versions of SzPUFA OrfA, SzPUFA OrfB, hSzThPUFA OrfC, SzACS-2, and NoHetI. The version of the phaseolin promoter used in this construct was modified essentially as described in Bustos et al., 1989 (The Plant Cell, Vol. 1; 839-853), wherein the 5' portion of the promoter was truncated and the phaseolin 5' untranslated region was left intact. The truncated phaseolin promoter sequences are identified throughout this application as version 4 (v4), version 5 (v5), and version 6 (v6). The pDAB101412 plasmid (FIG. 36; SEQ ID NO:56) was constructed using a multi-site Gateway L-R recombination reaction.

pDAB101412 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvPhas Promoter v4, PvPhas 5' UTR, SzPUFA OrfA v3 and AtuORF23 3' UTR v1. The second PUFA synthase PTU contains the PvPhas Promoter v4, PvPhas 5' UTR, SzPUFA OrfB v3 and AtuORF23 3' UTR v1. The third PUFA synthase PTU contains the PvPhas Promoter v4, PvPhas 5' UTR, hSzThPUFA OrfC v3 and AtuORF23 3' UTR v1. The acyl-CoA synthetase PTU contains the PvPhas Promoter v4, PvPhas 5' UTR, 2S 5' UTR, SzACS-2 v3 gene and AtuORF23 5' UTR v1. The phosphopantetheinyl transferase PTU contains the PvPhas Promoter v5, PvPhas 5' UTR, NoHetI v3 and AtuORF23 3' UTR v1.

Plasmids pDAB7375, pDAB7376, pDAB7377, pDAB7398 and pDAB7333 were recombined to form pDAB101412. Specifically, the five PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, SzACS-2 v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the six PTUs with restriction enzyme digestion and DNA sequencing.

Canola Transformation with Promoters which Express Early in Seed Development

The plasmids are used to stably transform canola plants using the protocols described above. Transgenic canola plants are isolated and molecularly characterized. The use of alternative constructs result in canola plants which contain greater amounts of DHA and LC-PUFAs. The resulting LC-PUFA accumulation is determined and canola plants which produce 0.01% to 15% DHA or 0.01% to 15% LC-PUFA are identified.

Example 13

Co-Expression of DGAT2 or ACCase with the Algal PUFA Synthase Gene Suite within Canola Oil content within canola plants is further modified by transformation of chimeric DNA molecules which encode and express an acetyl CoA carboxylase (ACCase) or an type 2 diacylglycerol acyltransferase (DGAT2). These genes are co-expressed with the algal PUFA synthase genes described above, either through breeding canola plants containing the ACCase or DGAT2 expression cassette with canola plants containing the PUFA synthase genes; or by transforming canola plants with a gene stack containing the ACCase or DGAT2 and the PUFA synthase genes. Regulatory elements necessary for expression of an ACCase or DGAT2 coding sequence can include those described above. Additional regulatory elements expression sequences known in the art can also be used. The ACCase and DGAT2 expression cassettes are transformed into canola using transformation protocols described above. Transformation can occur as molecular stacks of the ACCase or DGAT2 expression cassette combined with the PUFA synthase OrfA, PUFA synthase OrfB, PUFA synthase OrfC, acyl-CoA synthetase and 4' phosphopantetheinyl transferase HetI expression cassettes; or as independent ACCase or DGAT2 expression cassettes linked to a selectable marker and then subsequently crossed with canola plants which contain the PUFA synthase OrfA, PUFA synthase OrfB, PUFA synthase OrfC, acyl-CoA synthetase and 4' phosphopantetheinyl transferase HetI expression cassettes. Positive transformants are isolated and molecularly characterized. Canola plants are identified which contain increased accumulation of LC-PUFAs in the plant, the seed of the plant, or plant oil concentrations compared to untransformed control canola plants. Such increases can range from a 1.2 to a 20-fold increase.

The over-expression of ACCase in the cytoplasm can produce higher levels of malonyl-CoA. Canola plants or seed containing increased levels of cytoplasmic malonyl-CoA can produce subsequently higher levels of the long-chain polyunsaturated fatty acid (LC-PUFA) when the algal PUFA synthase genes are present and expressed. DGAT2 genes which are expressed within canola plants can be capable of preferentially incorporating significant amounts of docosahexaenoic acid (DHA) and eicosapentaenoic acid (EPA) into triacylglycerol. DGAT2 genes with substrate preference toward LC-PUFAs (see e.g., WO 2009/085169) can increase incorporation of these fatty acids into triacylglycerol (TAG). Such DGAT genes are useful for directing the incorporation of LC-PUFA, particularly DHA, into TAG and for increasing the production of TAG in plants and other organisms.

Example 14

Use of the Native Acyl-CoA Synthetase Gene Sequence for Higher Levels of Acyl-CoA Synthetase Expression within Plants An alternative version of the acyl-CoA synthetase gene from *Schizochytrium* sp. was created by modifying the native gene sequence to remove superfluous open reading frames. This version was labeled as "SzACS-2 v4" and listed as SEQ ID NO:34. The sequence was synthesized by the service provider, DNA 2.0 (Menlo Park, Calif.). The coding sequence was incorporated into a plant expression cassette containing a promoter and a 3' untranslated region, which were described in these Examples. The resulting expression cassette was used to replace the acyl-CoA synthetase expression cassette, described above as "SzACS-2 v3," SEQ ID NO:9, which was combined with the PUFA synthase OrfA, PUFA synthase OrfB, PUFA synthase chimeric OrfC and 4' phosphopantetheinyl transferase HetI expression cassettes to construct pDAB7361, pDAB7362 and pDAB7363. The new plasmids which contain the "SzACS-2 v4" expression cassette were given unique identification labels. The newly constructed plasmids can be used to stably transform canola plants. Transgenic canola plants are isolated and molecularly characterized. The alternative version of the gene, "SzACS-2 v4," can result in canola plants which contain greater amounts of DHA and LC-PUFAs. The resulting LC-PUFA accumulation is determined and canola plants which produce 0.01% to 15% DHA or 0.01% to 10% EPA are identified.

Example 15

PUFA Synthase Activity in Mature Transgenic Canola Seed

Figure 16:
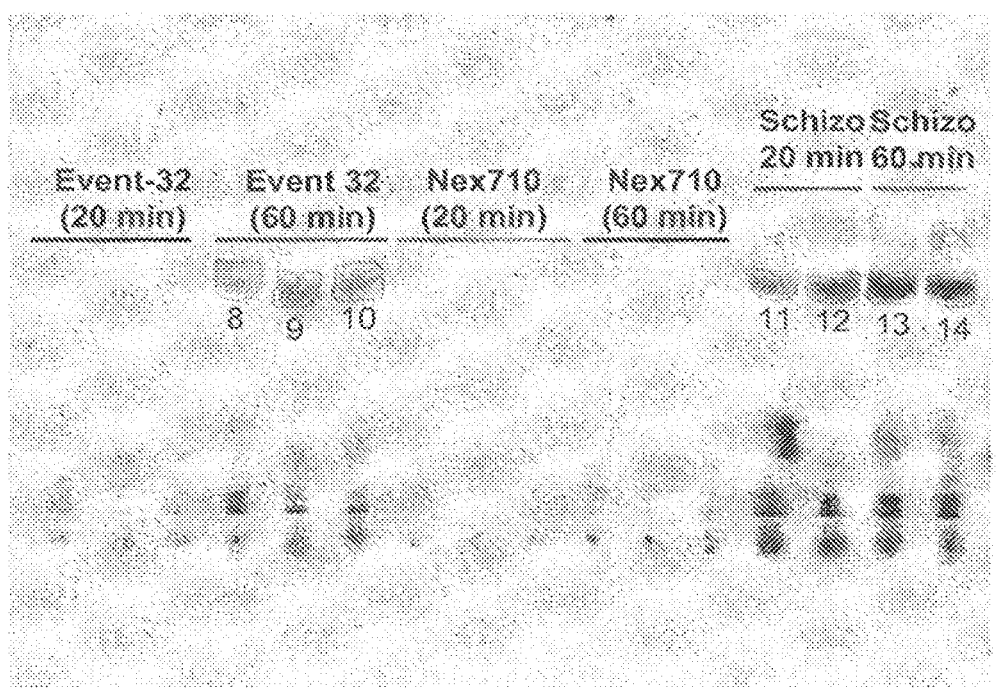
FIG. 16 shows PUFA synthase activity in mature transgenic canola seed measured by thin layer chromatography (TLC).

PUFA synthase activity was detected in extracts from mature T1 transgenic canola seed from plants generated utilizing the *Agrobacterium* vector pDAB 7361 (Event 5197 [14]-032). The seed was soaked with water for 3-4 hours prior to removing the seed coats and grinding on dry ice in extraction buffer (200 mM phosphate pH 7.0, 1 mM EDTA, 1 mM DTT, 50 mM NaCl, 5% glycerol, 1% PVPP, 0.52 µg/mL antipain, 0.58 µg/mL leupeptin, 0.83 µg/mL pepstatin A, 12 µg/mL TLCK, 12 µg/mL TPCK, and 6 µg/mL soybean trypsin inhibitor) and microfuging at 4° C. for 10 min. The fat pad was removed, and the resulting pellet was incubated with higher ionic strength buffer prior to re-centrifugation. The fat pad and lipid layer were removed from the sample and the aqueous supernatant passed through Zeba desalt columns pre-equilibrated with 50 mM phosphate pH 7.2, 1 mM DTT, 10% glycerol, and 1 mM EDTA. Untransformed Nexera 710 seeds were processed in parallel as a negative control. Samples from both seed sets were assayed using the HIP extraction and TLC method described in Metz et al., *Plant Physiol. Biochem.* 47:6 (2009) (FIG. 16). Assay conditions were modified to include 2 mM NADH, a NADH regeneration system (glucose+glucose dehydrogenase), continual shaking and a final malonyl-CoA concentration of 100 µM (0.064 µCi/100 µL per assay). Assays of the resulting supernatants were normalized by volume and indicated that FFA formation could be detected after 60 min. This was not observed in the Nexera 710 control, and indicates that the FFA formation was from DHA formation via PUFA synthase.

Example 16

Pantetheinylation of OrfA Produced in Canola by Co-Expressed HetI

OrfA contains nine acyl-carrier protein domains that each require derivatization with a phosphopantetheine group by a phosphopantetheinyl transferase (PPTase) to be functional. The degree of pantetheinylation of OrfA by the PPTase HetI in transgenic canola seeds was assessed by nano-liquid chromatography-mass spectrometry (nanoLC-MS) evaluation of tryptic peptides containing the pantetheinylation site from various OrfA samples.

Recombinant holo and apo Orf A polypeptide standards were produced in *E. coli* by co-expression with or without HetI. Expression of OrfA in the absence of HetI generates a non-functional protein because endogenous PPTases from *E. coli* are incapable of adding the phosphopantetheine group (Hauvermale et al., *Lipids* 41:739-747; 2006). In contrast, expression with HetI yields an OrfA protein which has a high degree of pantetheinylation. To extract *E. coli*-expressed OrfA, frozen cells from 0.5 L of recombinant cell culture were resuspended in 20 mL of extraction buffer: 20 mM Tris pH 7.0, 1 mg/mL lysozyme, 1 mM EDTA, 1 mM PMSF, 1 mM DTT, 0.52 µg/mL antipain, 0.58 µg/mL leupeptin, 0.83 µg/mL pepstatin A, 12 µg/mL TLCK, 12 µg/mL TPCK, 6 µg/mL soybean trypsin inhibitor. After lysis, the extract was treated with DNase and 4 mM $MgCl_2$, clarified by centrifugation and the supernatant frozen at −80° C.

Plant-produced OrfA was isolated from re-hydrated mature canola seeds of event 5197[14]-032.002 using the extraction method previously described for in vitro assay of canola-produced PUFA synthase. OrfA protein from both *E. coli* standards and the canola sample were enzymatically digested and analyzed by nanoLC-MS using an Agilent ChipCube nanochromatography inlet with MS analysis by an Agilent QTOF mass spectrometer (model 6530). The QTOF was programmed to carry out automated $MS^2$ analysis to generate peptide sequence data during chromatography. The essential feature of the method is that the mass spectrometer is programmed to carry out a full-scan MS scan, followed by automated $MS^2$ of the three most abundant ions to generate $MS^2$ sequence spectra. Ions were subsequently excluded from $MS^2$ after 2 occurrences, for an exclusion period of 30 sec. An internal reference was continuously infused during nanospray to generate reference ions for internal calibration of the QTOF (at m/z 299.29446 and 1221.99064). Ions commonly found from carry-over of the calibration stock were defined as excluded ions, in order to prevent spurious $MS^2$ scans of these ions. MS scans were carried over the range of m/z 295-2400. $MS^2$ scans were carried over the range of m/z 59-3000. Automated $MS^2$ was carried out giving preference to charge states in the following order: +2>+3>(>+3)>unknown>+1.

Tandem mass spectra were extracted by Mascot Distiller (Matrix Science, London UK; version 2.3.2). Charge state deconvolution and deisotoping were not performed. All MS/MS spectra were analyzed using Mascot (Matrix Science, London, UK; version 2.2.06) and X! Tandem (www.thegpm.org; version 2007.01.01.1). Mascot and X! Tandem were both set up to search a protein sequence database containing the full length sequence of the OrfA protein assuming trypsin digestion specificity. Mascot and X! Tandem were searched with a fragment ion mass tolerance of 0.30 Da and a parent ion tolerance of 10.0 ppm. Oxidation of methionine and phosphopantetheine of serine were specified in Mascot and X! Tandem as variable modifications.

Scaffold (version Scaffold_2_05_02, Proteome Software Inc., Portland, Oreg.) was used to validate MS/MS based peptide and protein identifications. Peptide identifications were accepted if they could be established at greater than 95.0% probability as specified by the Peptide Prophet algorithm (Keller et al., *Anal. Chem.* 74:5383-92 (2002)). Protein identifications were accepted if they could be established at greater than 99.0% probability and contained at least 2 identified peptides. Protein probabilities were assigned by the Protein Prophet algorithm (Nesvizhskii, *Anal Chem.* 75:4646-58 (2003)). Proteins that contained similar peptides and could not be differentiated based on MS/MS analysis alone were grouped to satisfy the principles of parsimony. Database searches identified tryptic peptides corresponding to the apo forms of pantetheinylation site 1 (SEQ ID NO:78 TGYETDMIEADMELETELGIDSIK) and pantetheinylation sites 2-9 (SEQ ID NO:77 TGYETDMIESDMELETELGIDSIK). Direct evidence for pantetheinylated peptides was not observed.

To estimate the degree of pantetheinylation of sites 2-9 in OrfA isolated from canola, the amount of the apo2-9 peptide was measured relative to six different reference peptides identified from other regions of the Orf A molecule (Table 21).

TABLE 21

Peptides used in calculating the relative amount of the apo2-9 peptide in OrfA digests. "Start" refers to the start position of the indicated peptide in the full length protein. The start position for apo2-9 refers to the first occurrence of the peptide in the protein sequence. The abbreviation "z" indicates charge, and the abbreviation m/z indicates mass over charge.

| SEQ ID NO: | Peptide | Amino acid start position | z | m/z |
| --- | --- | --- | --- | --- |
| SEQ ID NO: 71 | [LNYVVVEK] | 148 | 2 | 482.279 |
| SEQ ID NO: 72 | [FGALGGFISQQAER] | 2200 | 2 | 740.880 |
| SEQ ID NO: 73 | [AEIAGGSAPAPAAAAPAPAAAAPAPAAPAPAVSSELLEK] | 1416 | 4 | 851.452 |
| SEQ ID NO: 74 | [AAPAAAAPAVSNELLEK] | 1216 | 2 | 811.940 |
| SEQ ID NO: 75 | [IVQHRPVPQDKPFYITLR] | 2854 | 5 | 442.255 |
| SEQ ID NO: 76 | [IFVEFGPK] | 880 | 2 | 468.770 |
| apo2-9) SEQ ID NO. 77 | [TGYETDMIESDMELETELGIDSIK] | 1245 | 3 | 907.079 |

Figure 17:
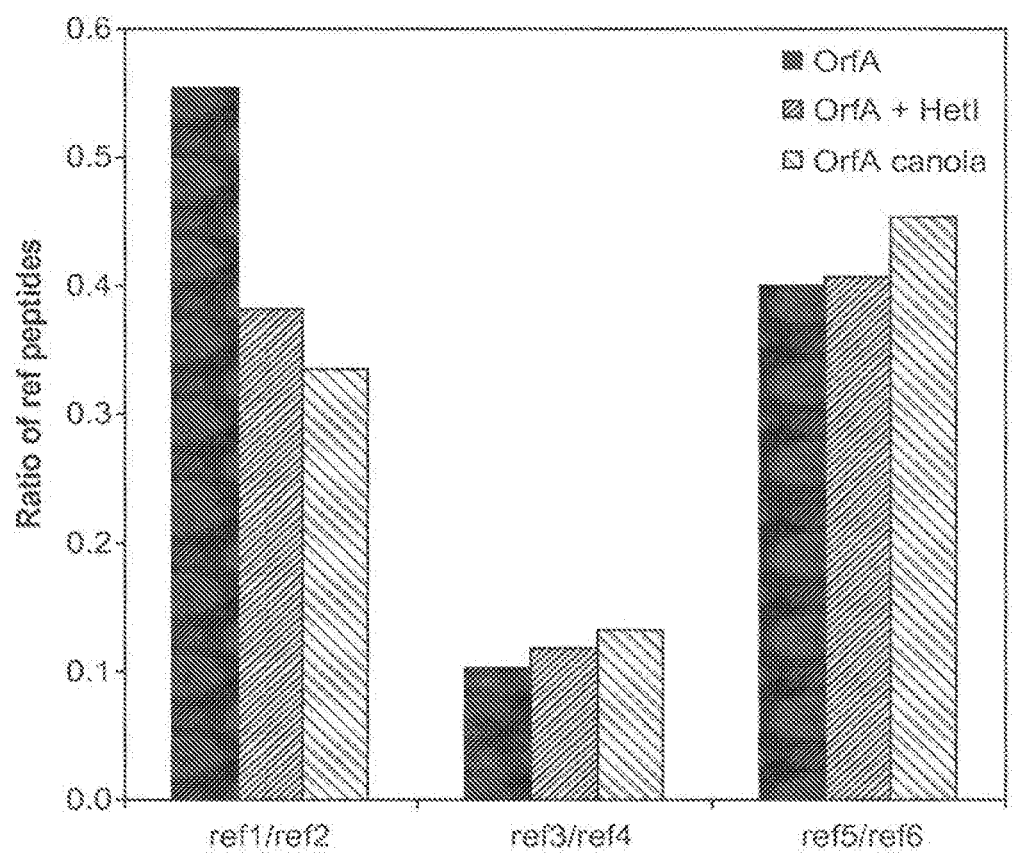
FIG. 17 shows the calculated ratios of reference peptides to each other from OrfA expressed in *E. coli* with and without co-expressed HetI, and OrfA expressed in canola event 5197[14]-032.002.

The internal ratio of the apo2-9 peptide to the reference peptides in the *E. coli* derived protein (without HetI) was taken as an estimate of no pantetheinylation, whereas the internal ratio in the *E. coli* derived protein expressed with HetI was taken as an estimate of a high degree of pantetheinylation. These internal ratios assume that the molar abundance of the reference peptides is equivalent, regardless of the source of the OrfA protein (FIG. 17). The ratio of the apo2-9 peptide to each of the six reference peptides was calculated and averaged. (Three ratios were calculated for the six reference peptides.) In addition, three ratios of six reference peptides to each other were calculated (ref1/ref2, ref3/ref4 and ref5/ref6) to demonstrate that the reference peptides did not vary significantly between the three OrfA samples (FIG. 17) and would be suitable for calculating the relative amount of the apo2-9 peptide present.

Figure 18:
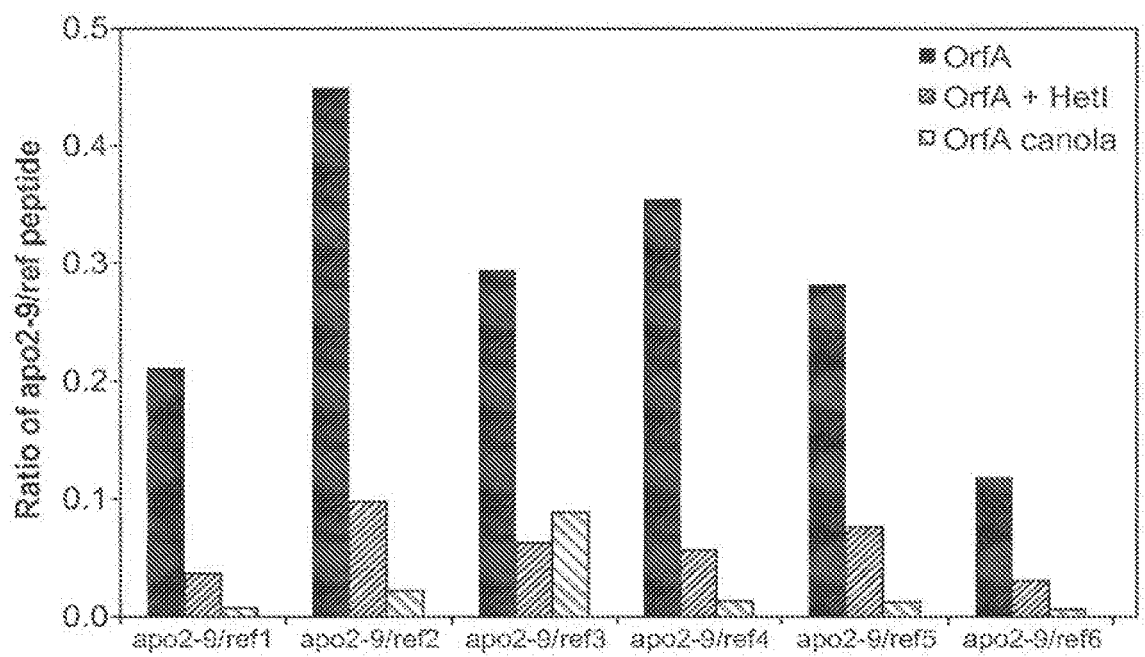
FIG. 18 shows the calculated ratios of the apo2-9 peptide to each of six reference peptides from OrfA expressed in *E. coli* with and without HetI, and OrfA expressed in transgenic canola event 5197[14]-032.002.

In contrast to the calculated ratios of the reference peptides, the ratio of apo2-9 to each of the reference peptides showed that there were dramatically lower levels of the apo2-9 peptide in both OrfA/HetI and the canola samples in comparison to the OrfA standard without HetI, (FIG. 18). The simplest explanation of these results is that the pantetheinylation site on the apo2-9 peptide is substantially occupied by phosphopantetheinyl groups, thereby significantly decreasing the molar abundance of apo2-9 peptides. This indicates that the canola-expressed PPTase, HetI, was functionally capable of activation of OrfA in transgenic canola seed, and the canola-expressed OrfA ACP units are functionally competent.

Example 17

Additional Constructs

Introducing Promoter Diversity to Reduce the Duplication of Regulatory Elements

Gene silencing is a phenomenon which has been observed in progeny generations of transgenic canola events. Several review articles discuss Transcriptional Gene Silencing (TGS) and Post Transcriptional Gene Silencing (PTGS), such as those of Waterhouse et al., 2001 (Nature 411:834-842), Vaucheret and Fagard, 2001 (Trends in Genetics 17(1):29-35, and Okamoto and Hirochika, 2001 (Trends in Plant Sci. 6 (11): 527-534). In plants, gene silencing can be triggered by the duplication of transgenic polynucleotide sequences (tandem repeat transgene sequences, inverted repeat transgene sequences, or multiple insertions into the chromosome) or when a sequence homologous to the target gene sequences is carried either by an infecting plant virus or by the T-DNA of *Agrobacterium tumefaciens*.

In addition, the duplication of transgene polynucleotide sequences can act as triggers for construct instability. Multiple transgene sequences which share high levels of sequence similarity can fold back on one another. Rearrangements can occur via homologous recombination, wherein intervening sequences of DNA are excised. As a result fragments of DNA which are located between repeated transgene polynucleotide sequences are excised.

One strategy in designing plasmid vectors is to introduce promoter diversity into a construct by incorporating multiple, unique seed specific promoters which maintain high level expression of each transgene. Introducing promoter sequence diversity into the plasmid vectors can reduce gene silencing and improve plasmid stability. Multiple seed specific promoters include PvDlec2, Phaseolin, and Napin (U.S. Pat. No. 5,608,152). These promoters are relatively comparable in promoter activity such as tissue specificity, levels of expression, duration of expression, etc.

Construction of pDAB7733

Figure 37:
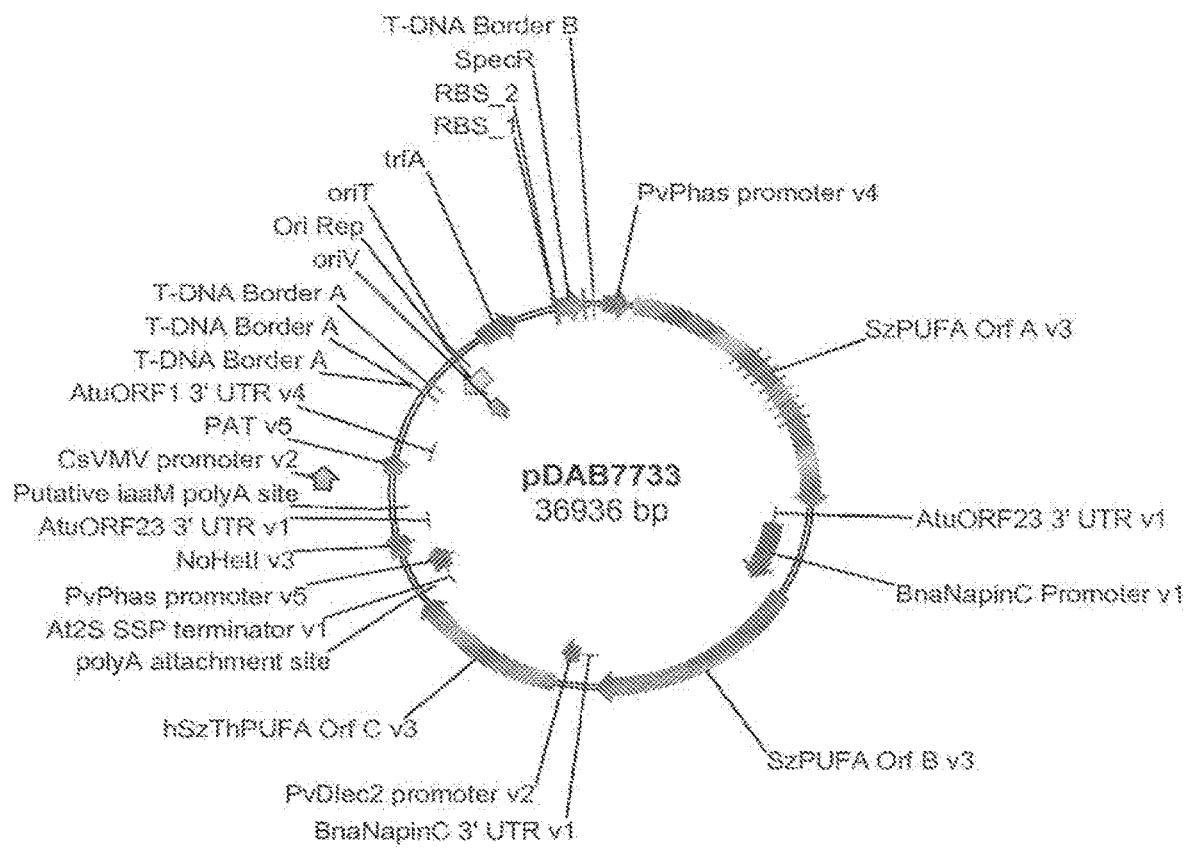
FIG. 37 shows the plasmid map of pDAB7733.

The pDAB7733 binary plasmid (FIG. 37; SEQ ID NO:57) was constructed using a multi-site Gateway L-R recombination reaction. pDAB7733 contains three PUFA synthase PTUs, one phosphopantetheinyl transferase PTU and a phosphinothricin acetyl transferase PTU. Specifically, the first PUFA synthase PTU contains the PvPhas promoter v4, PvPhas 5' UTR, SzPUFA OrfA v3 and AtuORF23 3' UTR v1. The second PUFA synthase PTU contains the BnaNapinC promoter v1, BnaNapinC 5' UTR, SzPUFA OrfB v3 and BnaNapinC 3' UTR v1. The third PUFA synthase PTU contains the PvDlec2 promoter v2, 2S 5' UTR, hSzThPUFA OrfC v3 and At2S SSP terminator v1. The phosphopantetheinyl transferase PTU contains the PvPhas promoter v5, PvPhas 5' UTR, NoHetI v3 and AtuOrf23 3' UTR v1.

Plasmids pDAB7375, pDAB7731, pDAB7336, pDAB7378 and pDAB7333 were recombined to form pDAB7733. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Construction of pDAB7734

Figure 38:
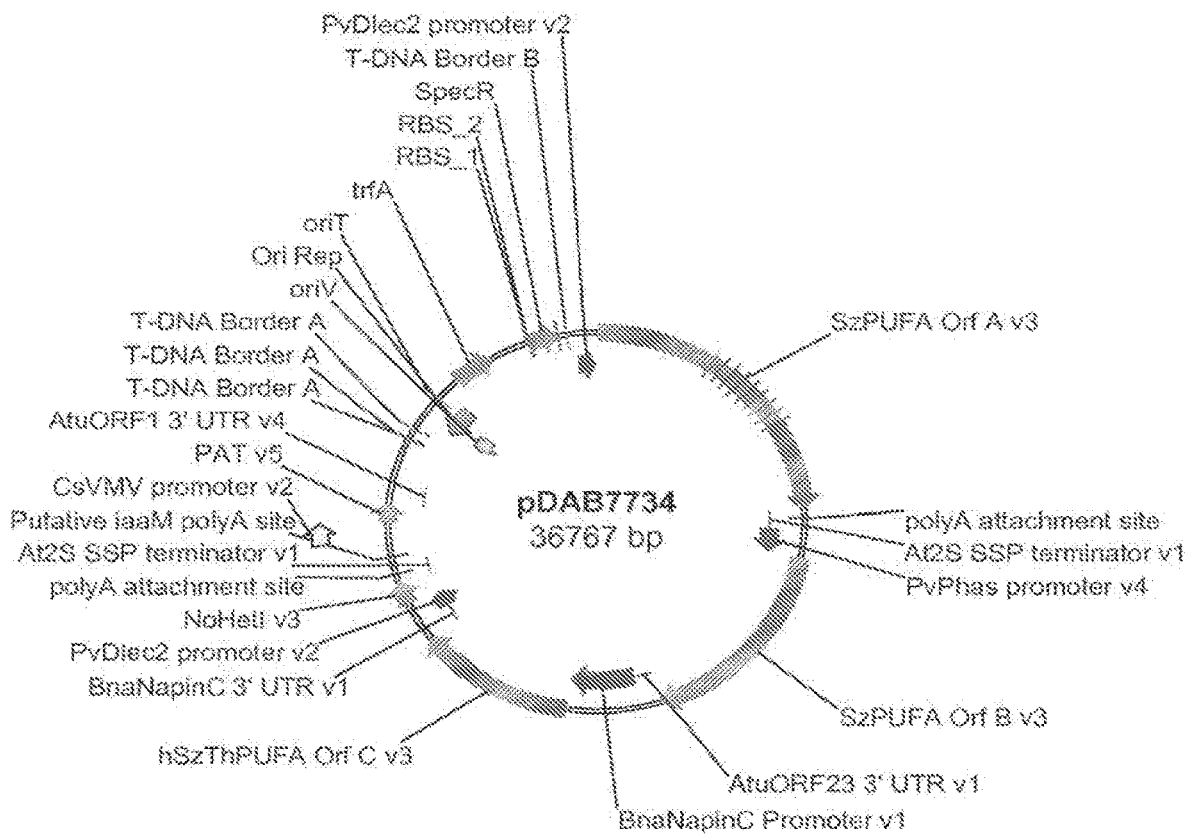
FIG. 38 shows the plasmid map of pDAB7734.

The pDAB7734 binary plasmid (FIG. 38; SEQ ID NO:58) was constructed using a multi-site Gateway L-R recombination reaction. pDAB7734 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvPhas promoter v4, PvPhas 5' UTR, SzPUFA OrfB v3 and AtuORF23 3' UTR v1. The third PUFA synthase PTU contains the BnaNapinC promoter v1, BnaNapinC 5' UTR, hSzThPUFA OrfC v3 and BnaNapinC 3' UTR v1. The phosphopantetheinyl transferase PTU contains the PvDlec2 promoter v2, 2S 5' UTR, NoHetI v3 and At2S SSP terminator v1.

Plasmids pDAB7334, pDAB7376, pDAB7732, pDAB7338 and pDAB7333 were recombined to form pDAB7734. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Construction of pDAB101493

Figure 39:
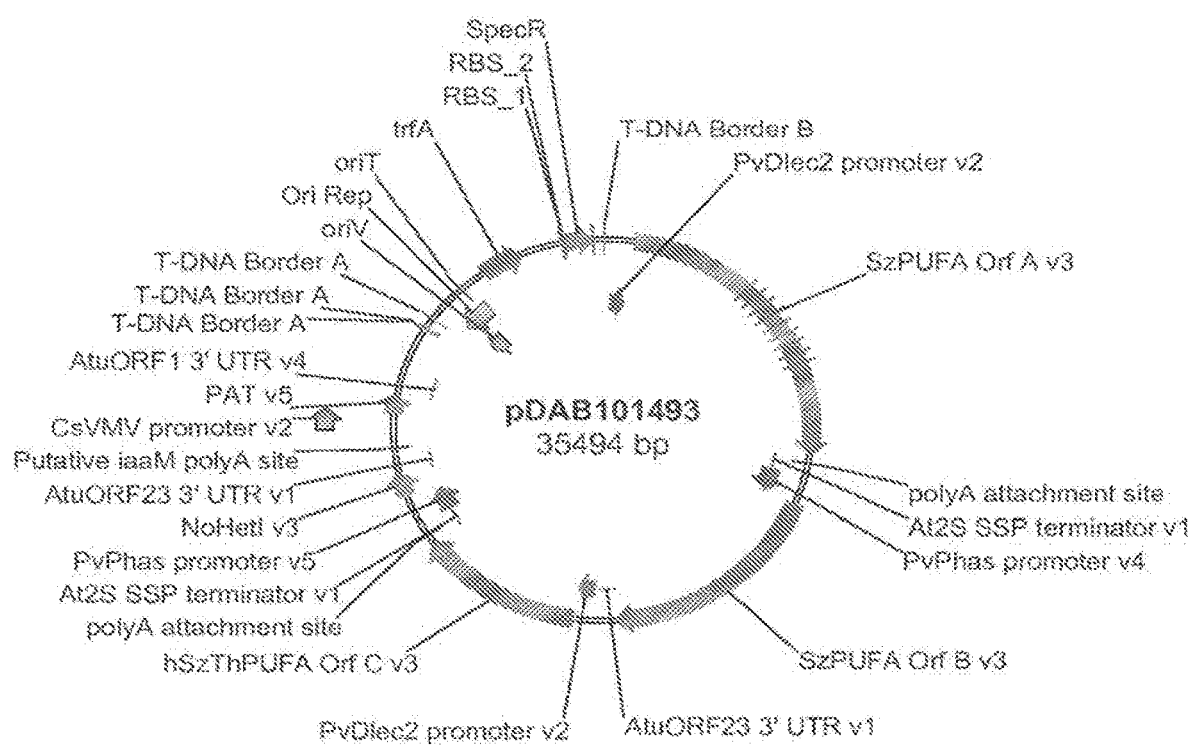
FIG. 39 shows the plasmid map of pDAB101493.

The pDAB101493 binary plasmid (FIG. 39; SEQ ID NO:59) was constructed using a multi-site Gateway L-R recombination reaction, pDAB101493 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvPhas promoter v4, PvPhas 5' UTR, SzPUFA OrfB v3 and AtuORF23 3' UTR v1. The third PUFA synthase PTU contains the PvDlec2 promoter v2, 2S 5' UTR, hSzThPUFA OrfC v3 and At2S SSP terminator v1. The phosphopantetheinyl transferase PTU contains the PvPhas promoter v5, PvPhas 5' UTR, NoHetI v3 and AtuOrf23 3' UTR v1.

Plasmids pDAB7334, pDAB7376, pDAB7336, pDAB7378 and pDAB7333 were recombined to form pDAB101493. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Construction of pDAB109507

Figure 40:
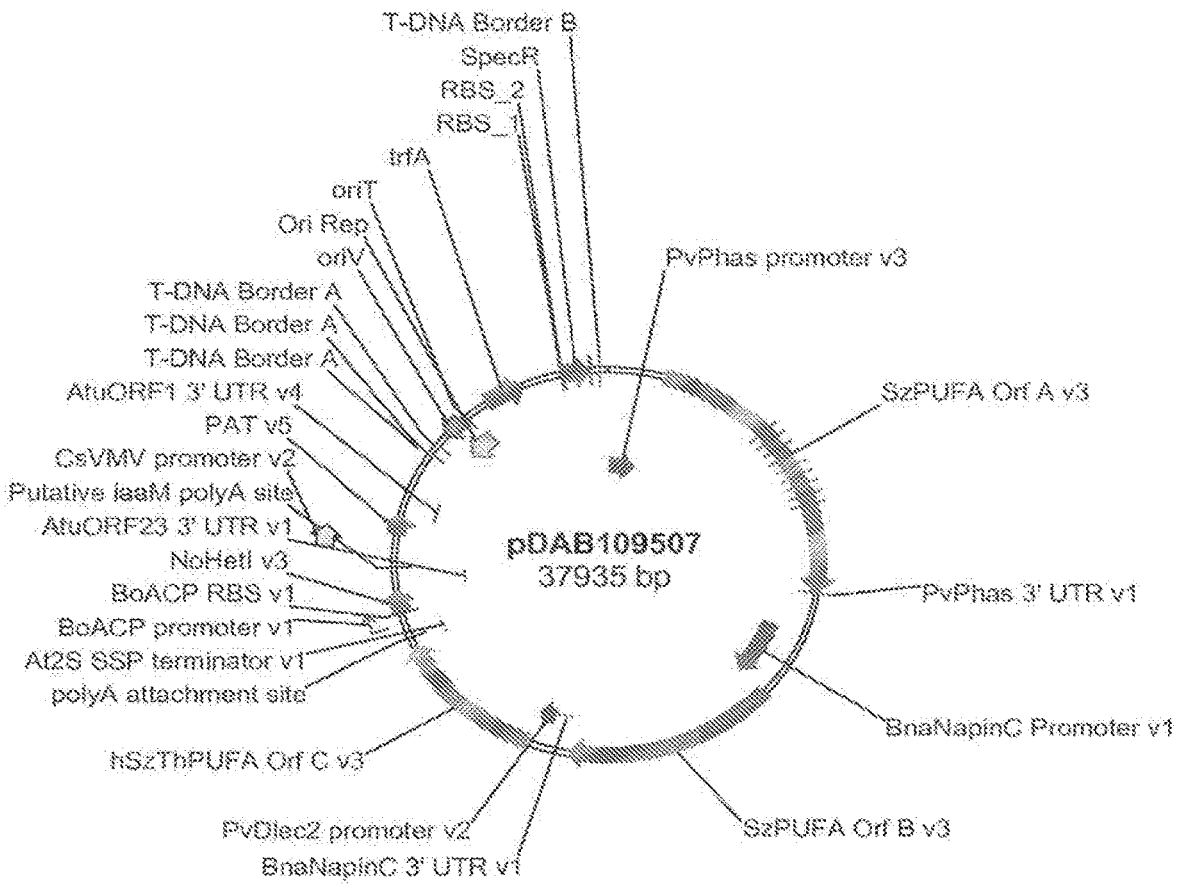
FIG. 40 shows the plasmid map of pDAB109507.

The pDAB109507 plasmid (FIG. 40; SEQ ID NO:60) was constructed using a multi-site Gateway L-R recombination reaction. pDAB109507 contains three PUFA synthase PTUs, one phosphopantetheinyl transferase PTU and a phosphinothricin acetyl transferase PTU. Specifically, the first PUFA synthase PTU contains the PvPhas promoter v3, PvPhas 5' UTR, SzPUFA OrfA v3 and PvPhas 3' UTR v1 and PvPhas 3' MAR v2 (unannotated on the plasmid map). The second PUFA synthase PTU contains the BnaNapinC promoter v1, BnaNapinC 5' UTR, SzPUFA OrfB v3 and BnaNapinC 3' UTR v1. The third PUFA synthase PTU contains the PvDlec2 promoter v2, 2S 5' UTR, hSzThPUFA OrfC v3 and At2S SSP terminator v1. The phosphopantetheinyl transferase PTU contains the BoACP promoter/5' UTR v1, NoHetI v3 and AtuOrf23 3' UTR v1.

Plasmids pDAB9324, pDAB7731, pDAB7336, pDAB101485 and pDAB7333 were recombined to form pDAB109507. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Construction of pDAB109508

Figure 41:
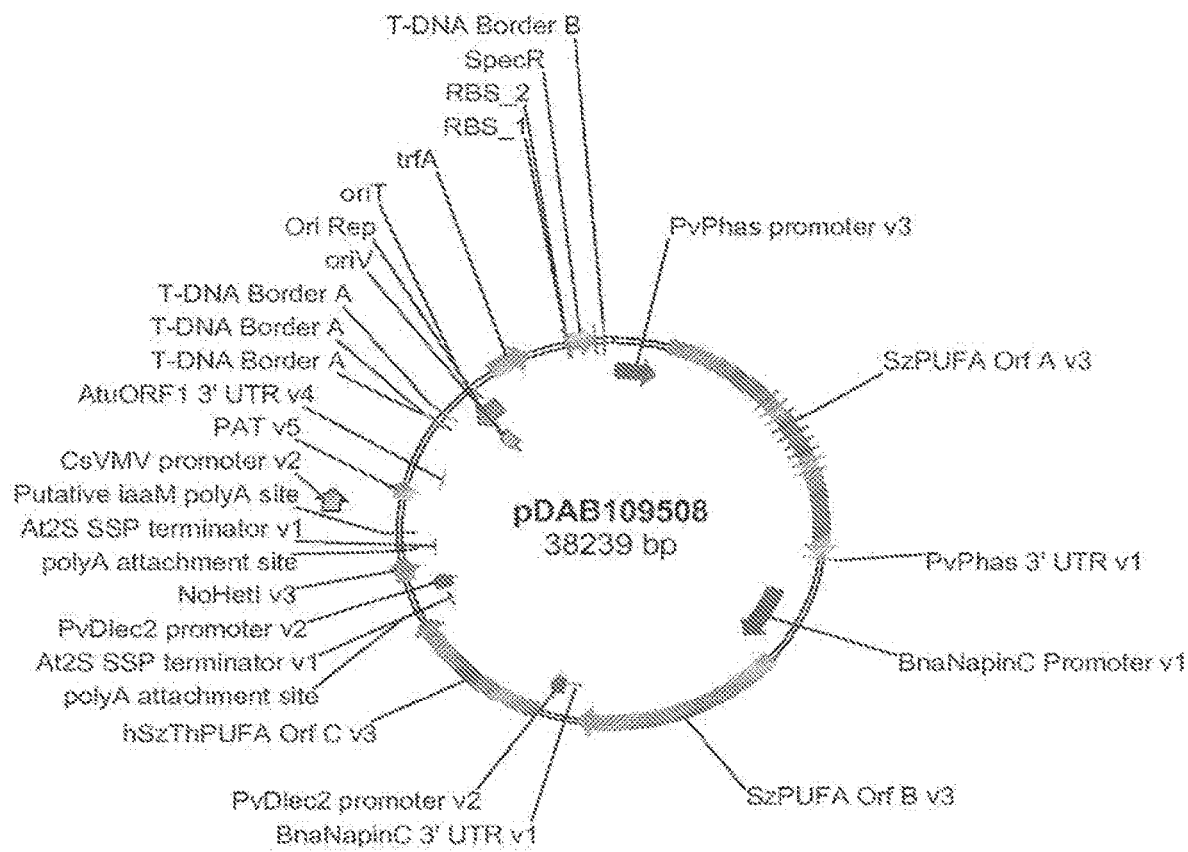
FIG. 41 shows the plasmid map of pDAB109508.

The pDAB109508 plasmid (FIG. 41; SEQ ID NO:61) was constructed using a multi-site Gateway L-R recombination reaction. pDAB109508 contains three PUFA synthase PTUs, one phosphopantetheinyl transferase PTU and a phosphinothricin acetyl transferase PTU. Specifically, the first PUFA synthase PTU contains the PvPhas promoter v3, PvPhas 5' UTR, SzPUFA OrfA v3 and PvPhas 3' UTR v1 and PvPhas 3' MAR v2 (unannotated on the plasmid map). The second PUFA synthase PTU contains the BnaNapinC promoter v1, BnaNapinC 5' UTR, SzPUFA OrfB v3 and BnaNapinC 3' UTR v1. The third PUFA synthase PTU contains the PvDlec2 promoter v2, 2S 5' UTR, hSzThPUFA OrfC v3 and At2S SSP terminator v1. The phosphopantetheinyl transferase PTU contains the PvDlec2 promoter v2, 2S 5' UTR, NoHetI v3 and At2S SSP terminator v1.

Plasmids pDAB9324, pDAB7731, pDAB7336, pDAB7338 and pDAB7333 were recombined to form pDAB109508. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Construction of pDAB109509

Figure 42:
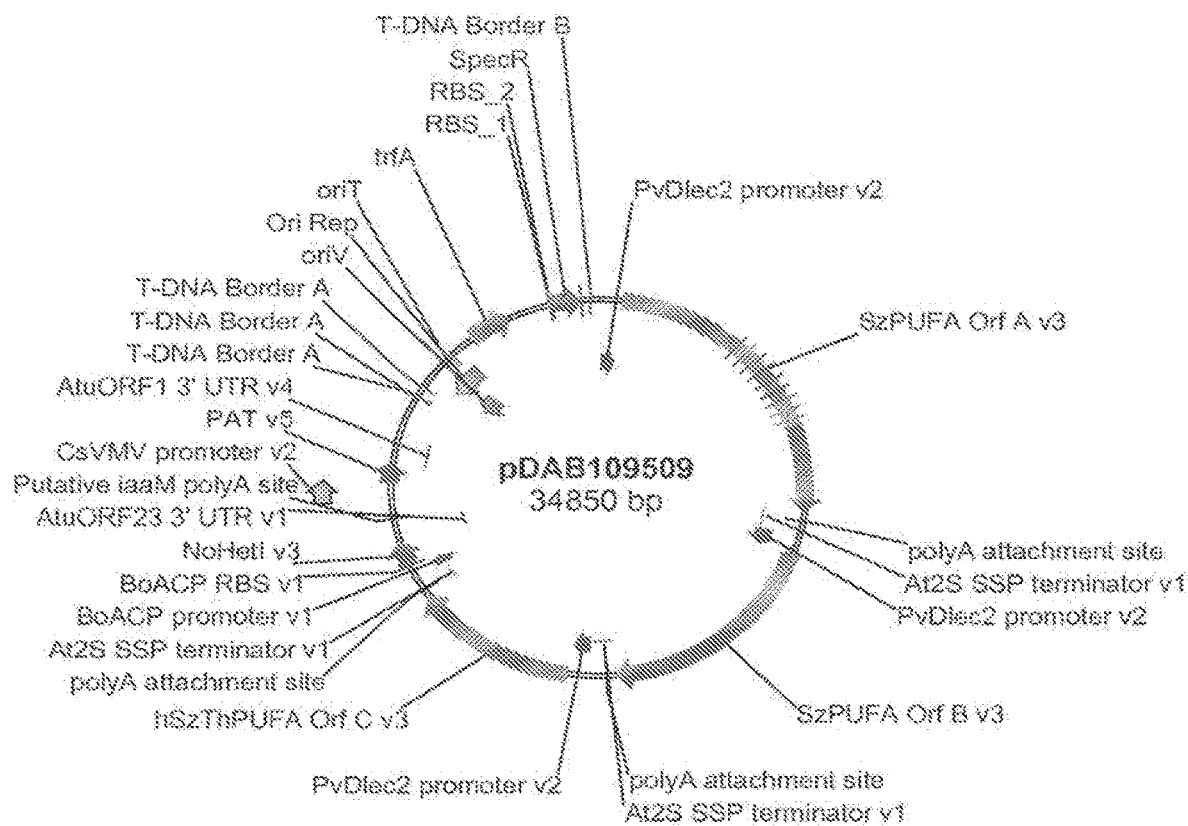
FIG. 42 shows the plasmid map of pDAB109509.

The pDAB109509 plasmid (FIG. 42; SEQ ID NO:62) was constructed using a multi-site Gateway L-R recombination reaction. pDAB109509 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The phosphopantetheinyl transferase PTU contains the BoACP promoter/5' UTR v1, NoHetI v3 and AtuOrf23 3' UTR v1.

Plasmids pDAB7334, pDAB7335, pDAB7336, pDAB101485 and pDAB7333 were recombined to form pDAB109509. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Rearranging the Order of the Binary Construct PTUs to Reduce Fragmentation of Long Gene Sequences The SzPUFA OrfA PTU was placed at the 3' end of the binary construct to test whether the order of the PTU cassettes could reduce fragmentation and rearrangements in isolated transgenic events. SzPUFA OrfA is a large open reading frame (~8,700 b.p.) containing nine tandem acyl carrier protein repeats. In the first series of completed constructs, the SzPUFA OrfA PTU was positioned to be integrated first into the plant chromosome. The SzPUFA OrfA PTU was subsequently followed by the remaining PUFA synthesis-related gene PTUs as they decreased in molecular size. Molecular analysis of the SzPUFA OrfA coding region indicated that some transgenic canola and Arabidopsis thaliana events contained fragmented insertions. Alternative Construct Designs are described, wherein the order of the PUFA synthase PTUs has been changed to the following configuration; hSzThPUFA OrfC PTU, SzPUFA OrfB PTU, NoHetI PTU, SzPUFA OrfA PTU, and PAT PTU. Changing the location of the SzPUFA OrfA PTU on the binary construct is completed to reduce fragmentation and rearrangement in isolated transgenic events Construction of pDAB9151

Figure 43:
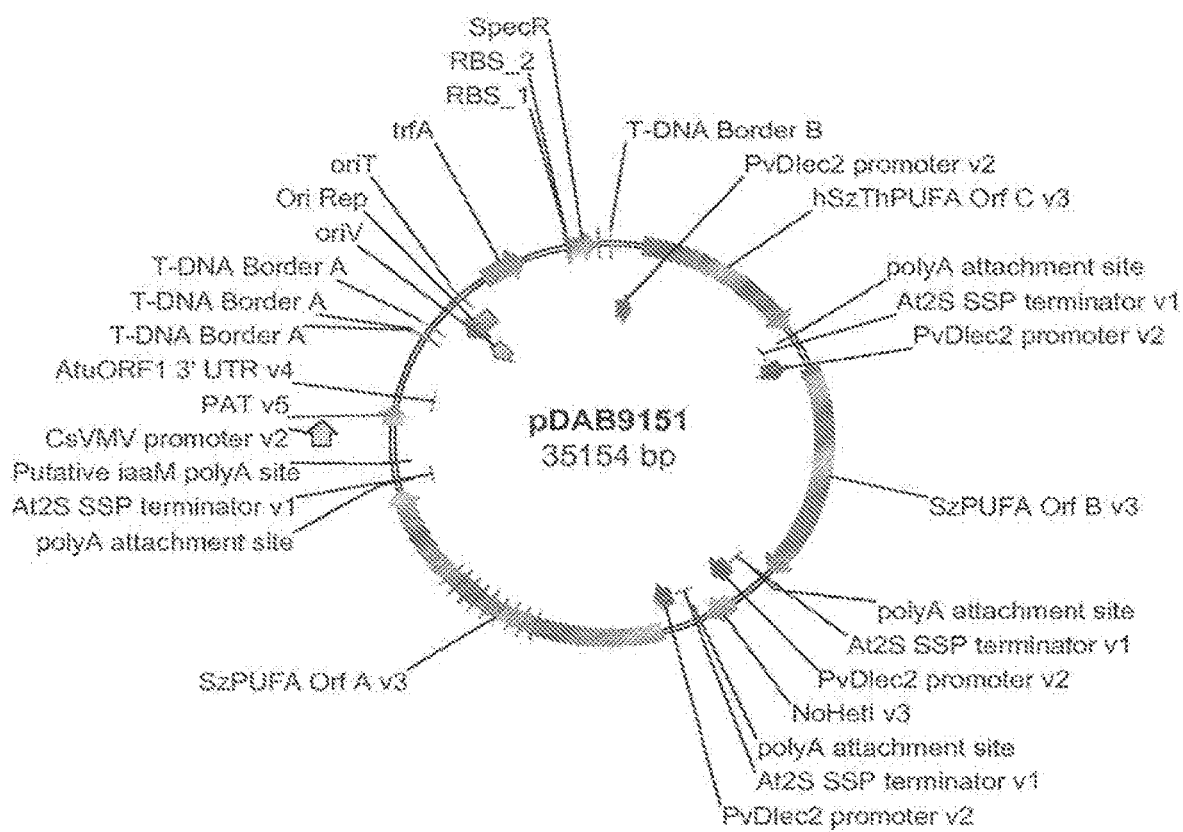
FIG. 43 shows the plasmid map of pDAB9151.

The pDAB9151 plasmid (FIG. 43; SEQ ID NO:63) was constructed using a multi-site Gateway L-R recombination reaction. pDAB9151 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfB v3 and At2S SSP terminator v1. The second PUFA synthase PTU contains the PvDlec2 promoter v2, 2S 5' UTR, hSzThPUFA OrfC v3 and At2S SSP terminator v1. The phosphopantetheinyl transferase PTU contains the PvDlec2 promoter v2, 2S 5' UTR, NoHetI v3 and At2S SSP terminator v1. The final PUFA synthase PTU contains the PvDlec2 promoter v2, 2S 5' UTR, SzPUFA OrfA v3 and At2S SSP terminator v1.

Plasmids pDAB9148, pDAB7335, pDAB9149, pDAB9150 and pDAB7333 were recombined to form pDAB9151. Specifically, the four PTUs described above were placed in a head-to-tail orientation within the T-strand DNA border regions of the plant transformation binary pDAB7333. The order of the genes is: hSzThPUFA OrfC v3, SzPUFA OrfB v3, NoHetI v3, SzPUFA OrfA v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Change the Transcriptional Direction of the Binary Construct PTUs to Introduce Construct Diversity An alternative construct design includes changing the order of PUFA synthase PTUs and the transcriptional direction of the gene expression cassettes. In the first series of completed constructs, each gene expression cassette was positioned in the same direction ("head to tail," wherein the promoter of one gene expression cassette is located adjacent to the 3'UTR of a second gene expression cassette). The following constructs describe a strategy wherein, gene expression cassettes are positioned in different directions, and utilize alternative promoters. In these examples, the gene expression cassette is located in trans to a second gene expression cassette such that the promoters of both gene expression cassettes are engineered adjacent to one another. This configuration is described as a "head-to-head" configuration. Other configurations are described in the examples, wherein one gene expression cassettes is located in trans to a second gene expression cassette such that the 3'UTRs of both gene expression cassettes are engineered adjacent to one another. This configuration is described as a "tail-to-tail" configuration. To mitigate potential read-through of such a design, the bidirectional Orf 23/24 terminator has been placed between these two PTUs. These configurations are proposed to increase expression of the transgenes, thereby resulting in higher concentrations and content of LC-PUFA and DHA fatty acid.

Construction of pDAB108207

Figure 44:
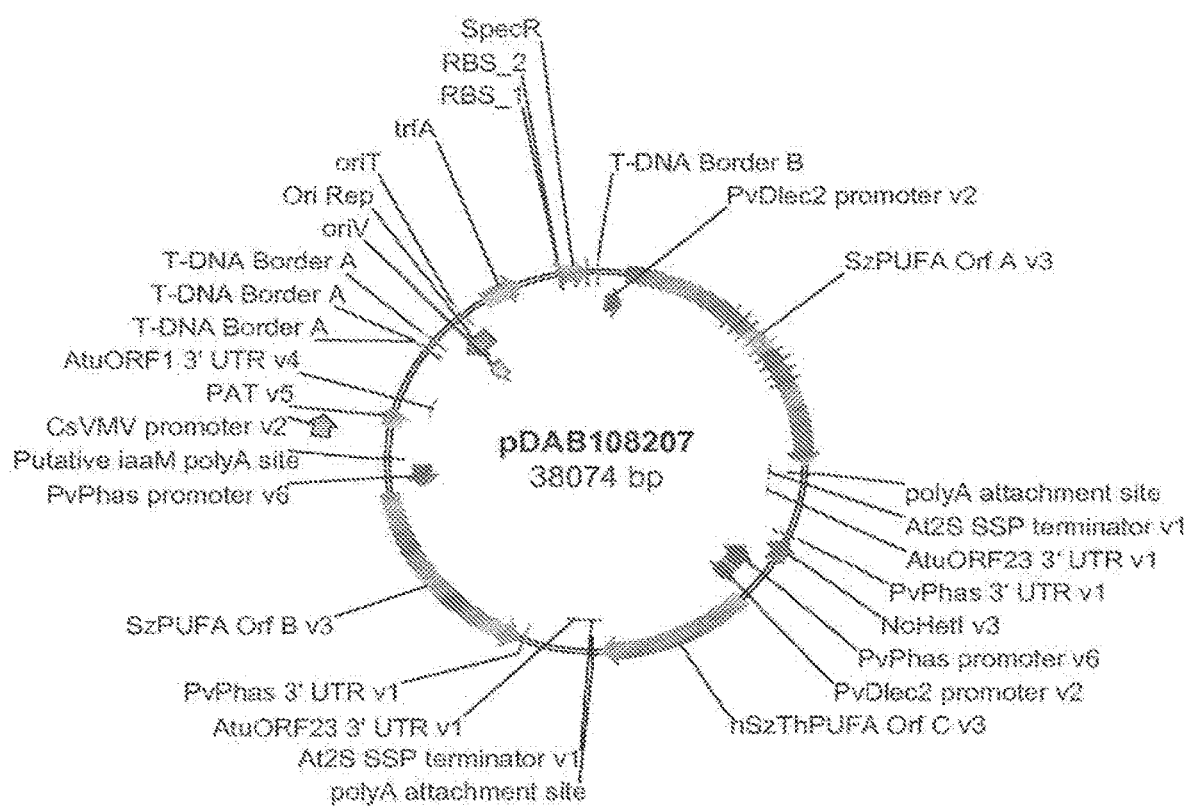
FIG. 44 shows the plasmid map of pDAB108207.

The pDAB108207 plasmid (FIG. 44; SEQ ID NO:64) was constructed using a multi-site Gateway L-R recombination reaction. pDAB108207 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The phosphopantetheinyl transferase PTU contains the PvPhas promoter v6, PvPhas 5' UTR, NoHetI v3, PvPhas 3' UTR v1 and PvPhas 3' MAR v2 (unannotated on the plasmid map). The second PUFA synthase PTU contains the PvDlec2 promoter v2, 2S 5' UTR, hSzThPUFA OrfC v3, At2S SSP terminator v1 and AtuORF23 3' UTR v1. The third PUFA synthase PTU contains the PvPhas promoter v6, PvPhas 5' UTR, SzPUFA OrfB v3, PvPhas 3' UTR and PvPhas 3' MAR v2 (unannotated on the plasmid map) and AtuORF23 3' UTR v1.

Plasmids pDAB7334, pDAB101489, pDAB108205, pDAB108206 and pDAB7333 were recombined to form pDAB108207. Specifically, the SzPUFA OrfA v3 and NoHetI v3 are placed in a tail-to-tail orientation; NoHetI v3 and hSzThPUFA OrfC v3 are placed in a head-to-head orientation; hSzThPUFA OrfC v3 and SzPUFA OrfB are placed in a tail-to-tail orientation within the T-strand DNA border regions of the plant transformation binary pDAB7333. The order of the genes is: SzPUFA OrfA v3, NoHetI v3, hSzThPUFA OrfC v3, SzPUFA OrfB v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Construction of pDAB108208

Figure 45:
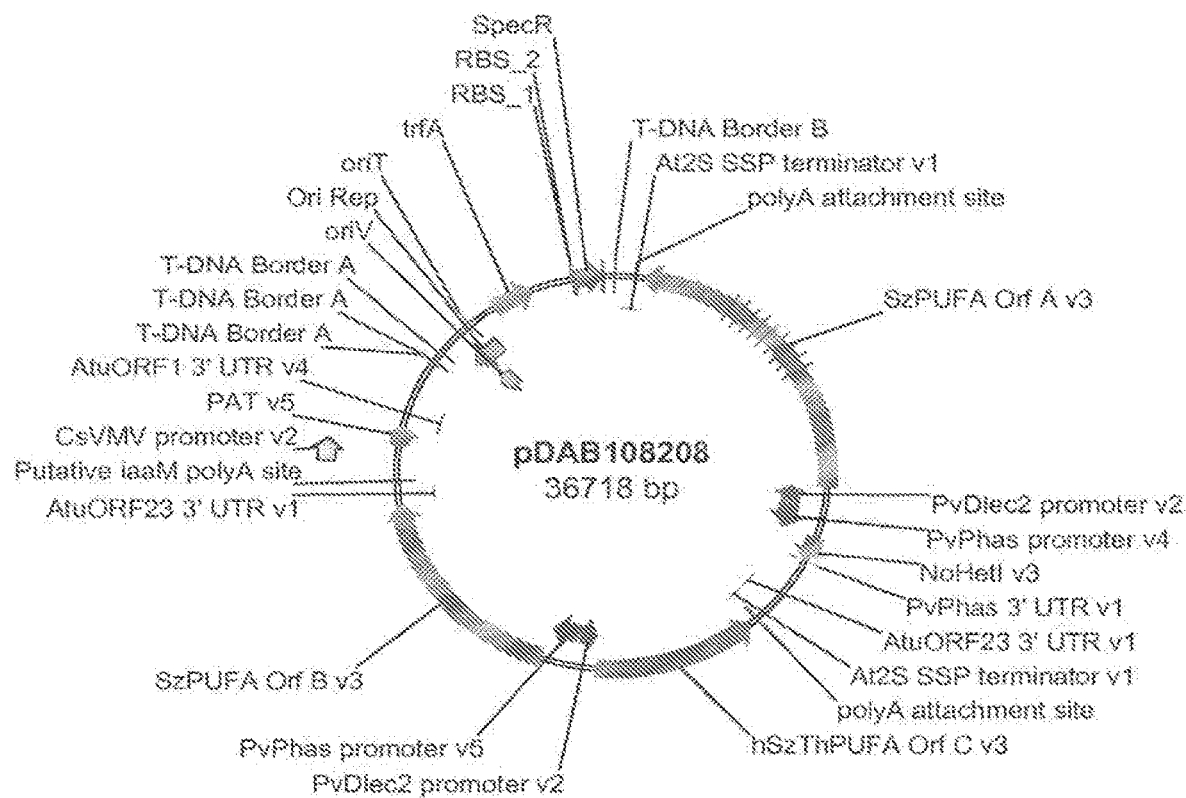
FIG. 45 shows the plasmid map of pDAB108208.

The pDAB108208 plasmid (FIG. 45; SEQ ID NO:65) was constructed using a multi-site Gateway L-R recombination reaction. pDAB108208 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The phosphopantetheinyl transferase PTU contains the PvPhas promoter v4, PvPhas 5' UTR, NoHetI v3 and AtuORF23 3' UTR v1. The second PUFA synthase PTU contains the PvDlec2 promoter v2, 2S 5' UTR, hSzThPUFA OrfC v3 and At2S SSP terminator v1. The third PUFA synthase PTU contains the PvPhas promoter v5, PvPhas 5' UTR, SzPUFA OrfB v3, PvPhas 3' UTR, PvPhas 3' MAR v2 (unannotated on the plasmid map), and AtuORF23 3' UTR v1.

Plasmids pDAB108200, pDAB101490, pDAB108201, pDAB108202 and pDAB7333 were recombined to form pDAB108208. Specifically, the SzPUFA OrfA v3 and NoHetI v3 are placed in a head-to-head orientation; NoHetI v3 and hSzThPUFA OrfC v3 are placed in a tail-to-tail orientation; hSzThPUFA OrfC v3 and SzPUFA OrfB are placed in a head-to-head orientation within the T-strand DNA border regions of the plant transformation binary pDAB7333. The order of the genes is: SzPUFA OrfA v3, NoHetI v3, hSzThPUFA OrfC v3, SzPUFA OrfB v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Construction of pDAB108209

Figure 46:
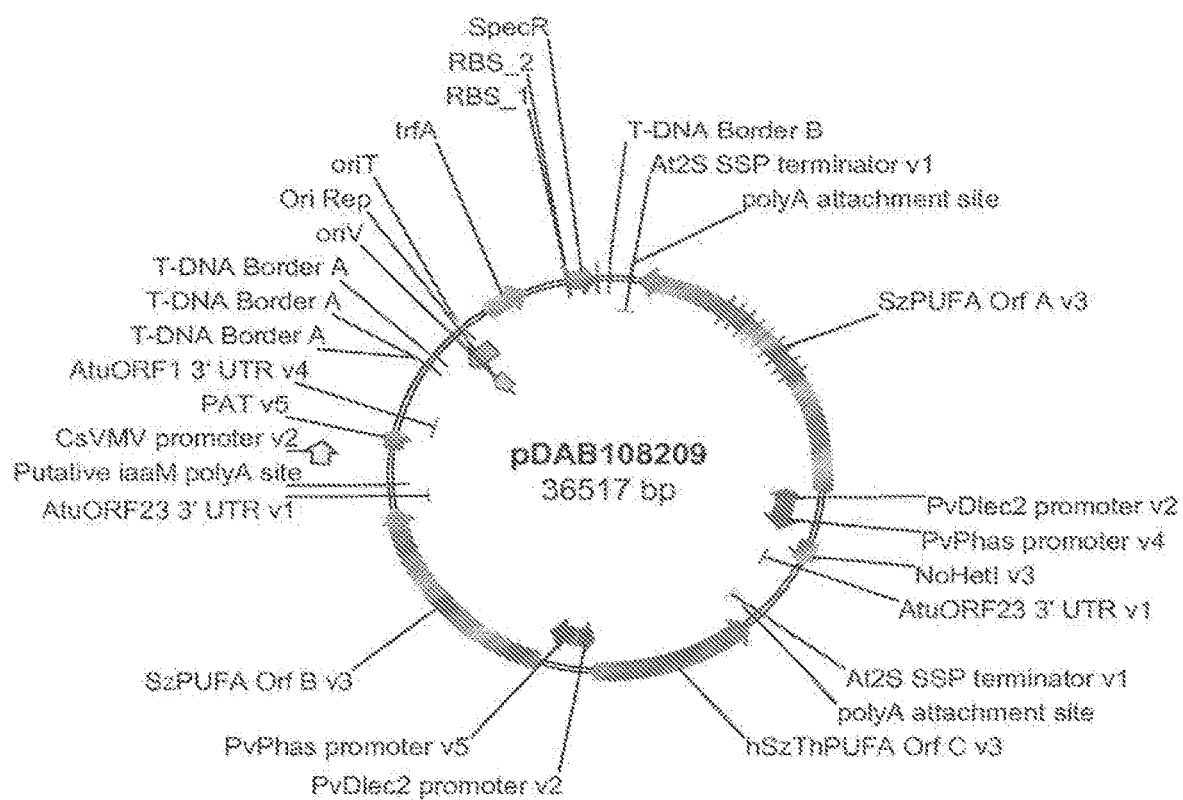
FIG. 46 shows the plasmid map of pDAB108209.

The pDAB108209 plasmid (FIG. 46; SEQ ID NO:66) was constructed using a multi-site Gateway L-R recombination reaction. pDAB108209 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The phosphopantetheinyl transferase PTU contains the PvPhas promoter v4, PvPhas 5' UTR, NoHetI v3 and AtuORF23 3' UTR v1. The second PUFA synthase PTU contains the PvDlec2 promoter v2, 2S 5' UTR, hSzThPUFA OrfC v3 and At2S SSP terminator v1. The third PUFA synthase PTU contains the PvPhas promoter v5, PvPhas 5' UTR, SzPUFA OrfB v3, PvPhas 3' UTR and PvPhas 3' MAR v2 (unannotated on the plasmid map), and random DNA spacer.

Plasmids pDAB108200, pDAB108204, pDAB108201, pDAB108202 and pDAB7333 were recombined to form pDAB108209. Specifically, the SzPUFA OrfA v3 and NoHetI v3 are placed in a head-to-head orientation; NoHetI v3 and hSzThPUFA OrfC v3 are placed in a tail-to-tail orientation; hSzThPUFA OrfC v3 and SzPUFA OrfB are placed in a head-to-head orientation within the T-strand DNA border regions of the plant transformation binary pDAB7333. The order of the genes is: SzPUFA OrfA v3, NoHetI v3, hSzThPUFA OrfC v3, SzPUFA OrfB v3. pDAB7333 also contains the phosphinothricin acetyl transferase PTU: CsVMV promoter v2, PAT v5, AtuORF1 3' UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Doubling 3'UTRs and Including Spacer DNA to Minimize Transcriptional Interference.

Transcriptional interference can occur when multiple genes are stacked in a series thereby resulting in reduced expression of the downstream genes. This phenomenon results from transcriptional read-through of the 3'UTR and terminator into the next promoter-transcription unit. Alternative construct designs consisting of two strategies to minimize transcriptional interference and transcriptional interference are described. The first strategy deploys the use of two terminator/3'UTRs which are stacked between individual DHA gene expression cassettes to limit read-through into the next gene expression cassette. The second strategy inserts about one-thousand base pairs of spacer DNA between gene expression cassettes, thereby minimizing transcriptional interference.

Construction of pDAB108207

The pDAB108207 plasmid (FIG. 44; SEQ ID NO:64) was constructed using a multi-site Gateway L-R recombination reaction. pDAB108207 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvPhas promoter v3, PvPhas 5' UTR, SzPUFA OrfB v3, PvPhas 3' UTR, PvPhas 3' MAR v2 (unannotated on the plasmid map), and AtuORF23 3' UTR v1. The third PUFA synthase PTU contains the PvDlec2 promoter v2, 2S 5' UTR, hSzThPUFA OrfC v3, At2S SSP terminator v1 and AtuORF23 3' UTR v1. The phosphopantetheinyl transferase PTU contains the PvPhas promoter v6, PvPhas 5' UTR, NoHetI v3, PvPhas 3' UTR v1 and PvPhas 3' MAR v2 (unannotated on the plasmid map).

Plasmids pDAB7334, pDAB101489, pDAB108205, pDAB108206 and pDAB7333 were recombined to form pDAB108207. Specifically, the SzPUFA OrfA v3 and NoHetI v3 are placed in a tail-to-tail orientation and an AtuORF23 3'UTR is placed between the two PTUs; NoHetI v3 and hSzThPUFA OrfC v3 are placed in a head-to-head orientation; hSzThPUFA OrfC v3 and SzPUFA OrfB are placed in a head-to-tail orientation and an AtuORF23 3'UTR is placed between the two PTUs within the T-strand DNA border regions of the plant transformation binary pDAB7333. The order of the genes is: SzPUFA OrfA v3, NoHetI v3, hSzThPUFA OrfC v3, SzPUFA OrfB v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Construction of pDAB108208

The pDAB108208 plasmid (FIG. 45; SEQ ID NO:65) was constructed using a multi-site Gateway L-R recombination reaction. pDAB108208 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvPhas promoter v5, PvPhas 5' UTR, SzPUFA OrfB v3, PvPhas 3' UTR, PvPhas 3' MAR v2 (unannotated on the plasmid map) and AtuORF23 3' UTR v1. The third PUFA synthase PTU contains the PvDlec2 promoter v2, 2S 5' UTR, hSzThPUFA OrfC v3 and At2S SSP terminator v1. The phosphopantetheinyl transferase PTU contains the PvPhas promoter v4, PvPhas 5' UTR, NoHetI v3 and AtuORF23 3' UTR v1.

Plasmids pDAB108200, pDAB101490, pDAB108201, pDAB108202 and pDAB7333 were recombined to form pDAB108208. Specifically, the SzPUFA OrfA v3 and NoHetI v3 are placed in a head-to-head orientation; NoHetI v3 and hSzThPUFA OrfC v3 are placed in a tail-to-tail orientation and an AtuORF23 3'UTR is placed between the two PTUs; hSzThPUFA OrfC v3 and SzPUFA OrfB are placed in a head-to-head orientation within the T-strand DNA border regions of the plant transformation binary pDAB7333. The order of the genes is: SzPUFA OrfA v3, NoHetI v3, hSzThPUFA OrfC v3, SzPUFA OrfB v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Construction of pDAB108209

The pDAB108209 plasmid (FIG. 46; SEQ ID NO:66) was constructed using a multi-site Gateway L-R recombination reaction. pDAB108209 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvPhas promoter v5, PvPhas 5' UTR, SzPUFA OrfB v3, PvPhas 3' UTR, PvPhas 3' MAR v2 (unannotated on the plasmid map), and random DNA spacer. The third PUFA synthase PTU contains the PvDlec2 promoter v2, 2S 5' UTR, hSzThPUFA OrfC v3 and At2S SSP terminator v1. The phosphopantetheinyl transferase PTU contains the PvPhas promoter v4, PvPhas 5' UTR, NoHetI v3 and AtuORF23 3' UTR v1.

Plasmids pDAB108200, pDAB108204, pDAB108201, pDAB108202 and pDAB7333 were recombined to form pDAB108209. Specifically, the SzPUFA OrfA v3 and NoHetI v3 are placed in a head-to-head orientation; NoHetI v3 and hSzThPUFA OrfC v3 are placed in a tail-to-tail orientation and a one-thousand base pair spacer is placed between the two PTUs; hSzThPUFA OrfC v3 and SzPUFA OrfB are placed in a head-to-head orientation within the T-strand DNA border regions of the plant transformation binary pDAB7333. The order of the genes is: SzPUFA OrfA v3, NoHetI v3, hSzThPUFA OrfC v3, SzPUFA OrfB v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Using Alternative 3'UTR-Terminator to Limit Transcriptional Read-Through.

Due to a limited number of proprietary 3'UTR-terminators the *Agrobacterium* ORF 23 3'UTR-terminator is primarily used to terminate transcription. It was recently shown the ZmLipase 3'UTR-terminator is more effective in terminating transcriptional read-through in *Arabidopsis thaliana*. As such, one version of constructs utilize the ZmLipase 3'UTR-terminator in combination with the PvDlec2 promoter to test if this 3'UTR can reduce transcriptional read-through of upstream genes, thereby reducing transcriptional interference.

Construction of pDAB9159

Figure 47:
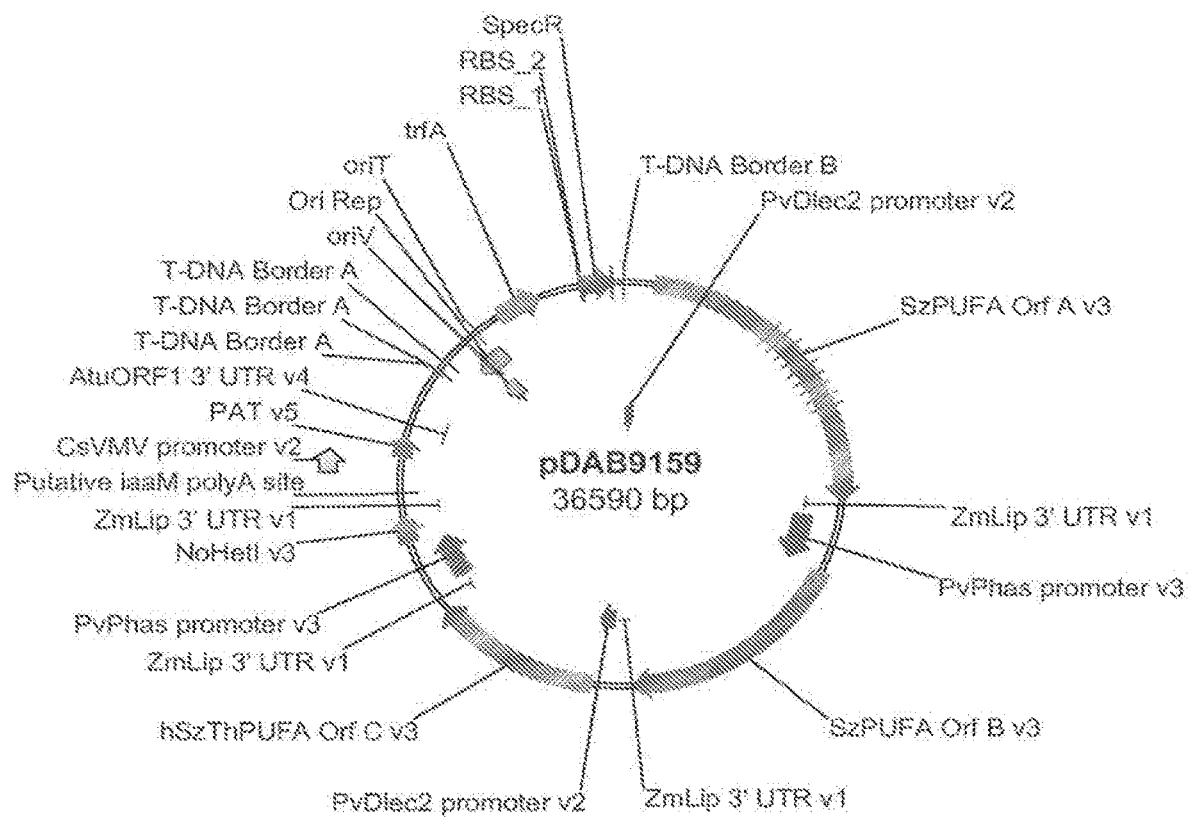
FIG. 47 shows the plasmid map of pDAB9159.

The pDAB9159 plasmid (FIG. 47; SEQ ID NO:67) was constructed using a multi-site Gateway L-R recombination reaction. pDAB9159 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and ZmLip 3' UTR v1. The second PUFA synthase PTU contains the PvPhas promoter v3, PvPhas 5' UTR, SzPUFA OrfB v3 and ZmLip 3' UTR v1. The third PUFA synthase PTU contains the PvDlec2 promoter v2, 2S 5' UTR, hSzThPUFA OrfC v3 and ZmLip 3' UTR v1. The phosphopantetheinyl transferase PTU contains the PvPhas promoter v3, PvPhas 5' UTR, NoHetI v3 and ZmLip 3' UTR v1.

Plasmids pDAB9152, pDAB9153, pDAB9154, pDAB9155 and pDAB7333 were recombined to form pDAB9159. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Construction of pDAB9147

Figure 48:
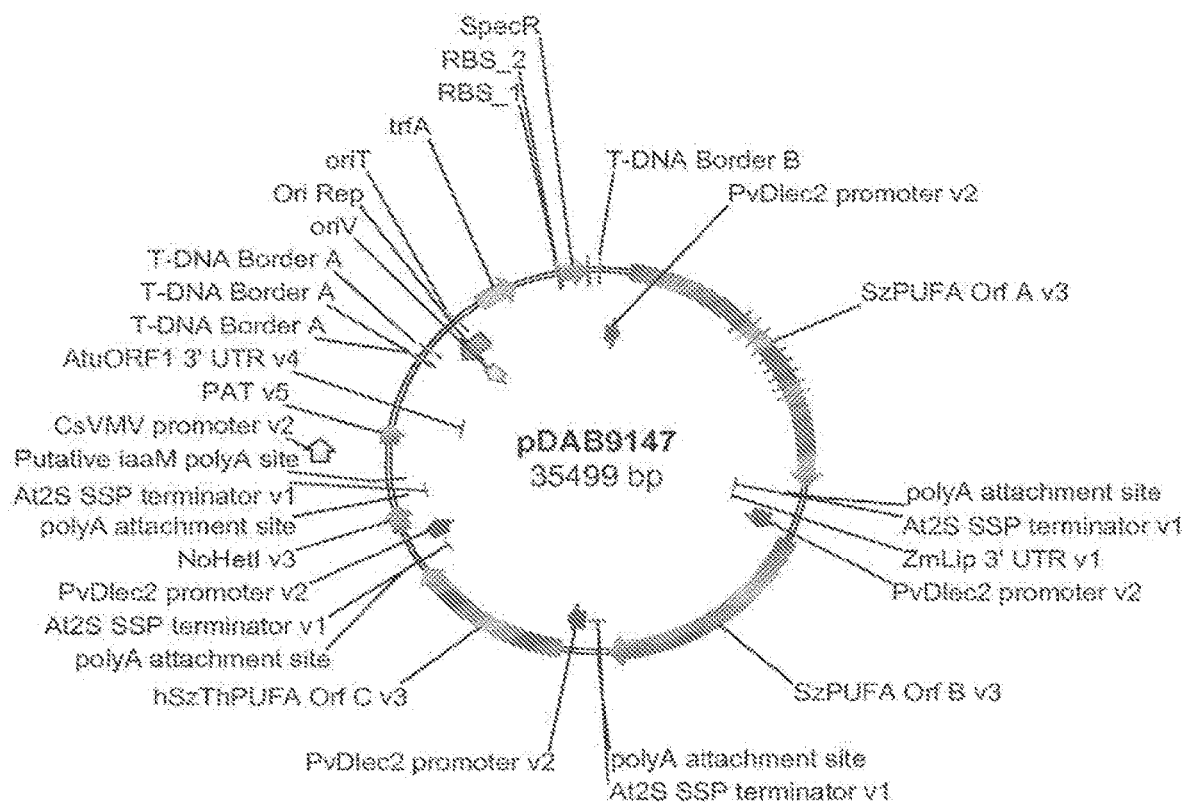
FIG. 48 shows the plasmid map of pDAB9147.

The pDAB9147 plasmid (FIG. 48; SEQ ID NO:68) was constructed using a multi-site Gateway L-R recombination reaction. pDAB9147 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3, At2S SSP terminator v1 and ZmLip 3' UTR v1. The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The phosphopantetheinyl transferase PTU contains the PvDlec2 promoter v2, 2S 5' UTR, NoHetI v3 and At2S SSP terminator v1.

Plasmids pDAB9146, pDAB7335, pDAB7336, pDAB7338 and pDAB7333 were recombined to form pDAB9147. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the five PTUs with restriction enzyme digestion and DNA sequencing.

Delivery of DHA Genes on Two Separate T-DNAs.

An alternative construct design consists of constructing two separate binary vectors, the first vector containing a sub-set of PUFA synthase genes on one T-DNA, and the second binary vector containing the remaining PUFA synthase genes on a second T-DNA. These binary vectors are individually used to transform plants which are sexually crossed, thereby resulting in progeny which contain all of the PUFA synthase gene expression constructs. An alternative method to produce transgenic plants would be to co-transform both binary vectors into canola tissue, and select or screen for a single plant which contain both T-strands.

Construction of pDAB108224

Figure 49:
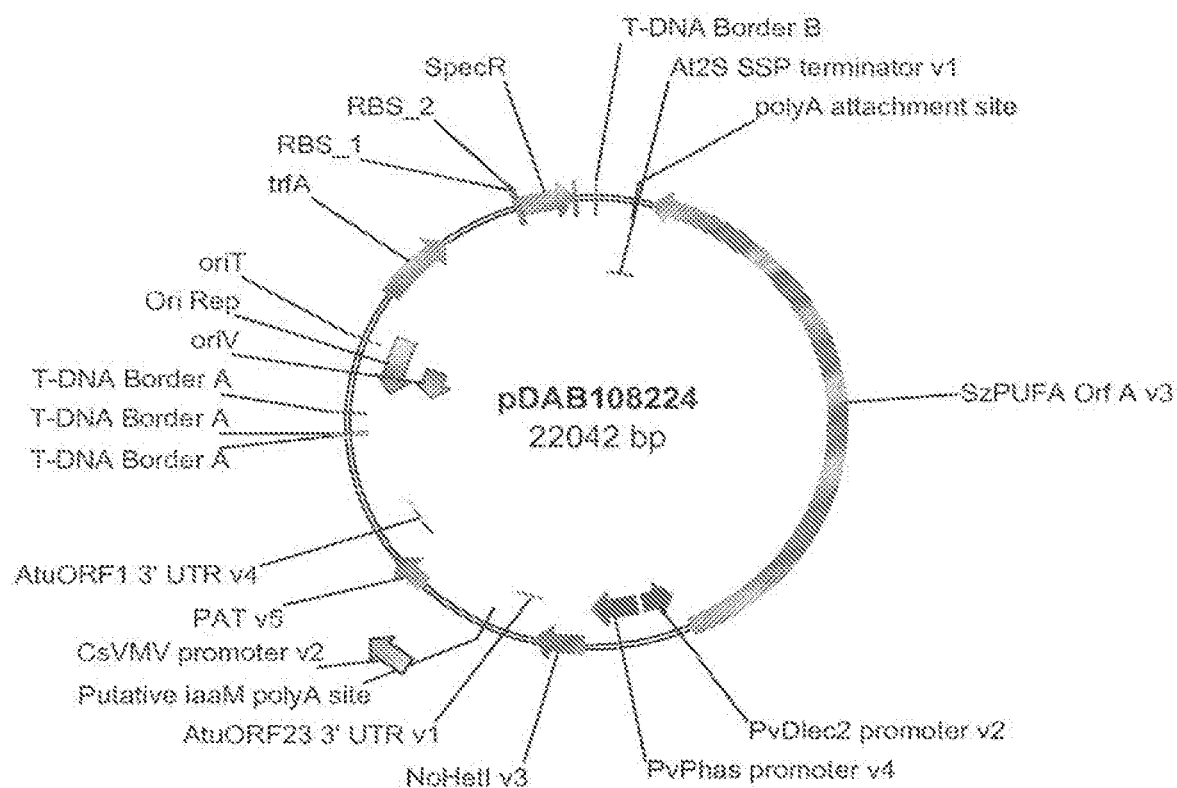
FIG. 49 shows the plasmid map of pDAB108224.

The pDAB108224 plasmid (FIG. 49; SEQ ID NO:69) was constructed using a multi-site Gateway L-R recombination reaction. pDAB108224 contains one PUFA synthase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The phosphopantetheinyl transferase PTU contains the PvPhas promoter v4, PvPhas 5' UTR, NoHetI v3 and AtuORF23 3' UTR v1.

Plasmids pDAB108216, pDAB108221 and pDAB7333 were recombined to form pDAB108224. Specifically, the SzPUFA OrfA v3 and NoHetI v3 are placed in a head-to-head orientation within the T-strand DNA border regions of the plant transformation binary pDAB7333. The order of the genes is: SzPUFA OrfA v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the three PTUs with restriction enzyme digestion and DNA sequencing.

Construction of pDAB108225

Figure 50:
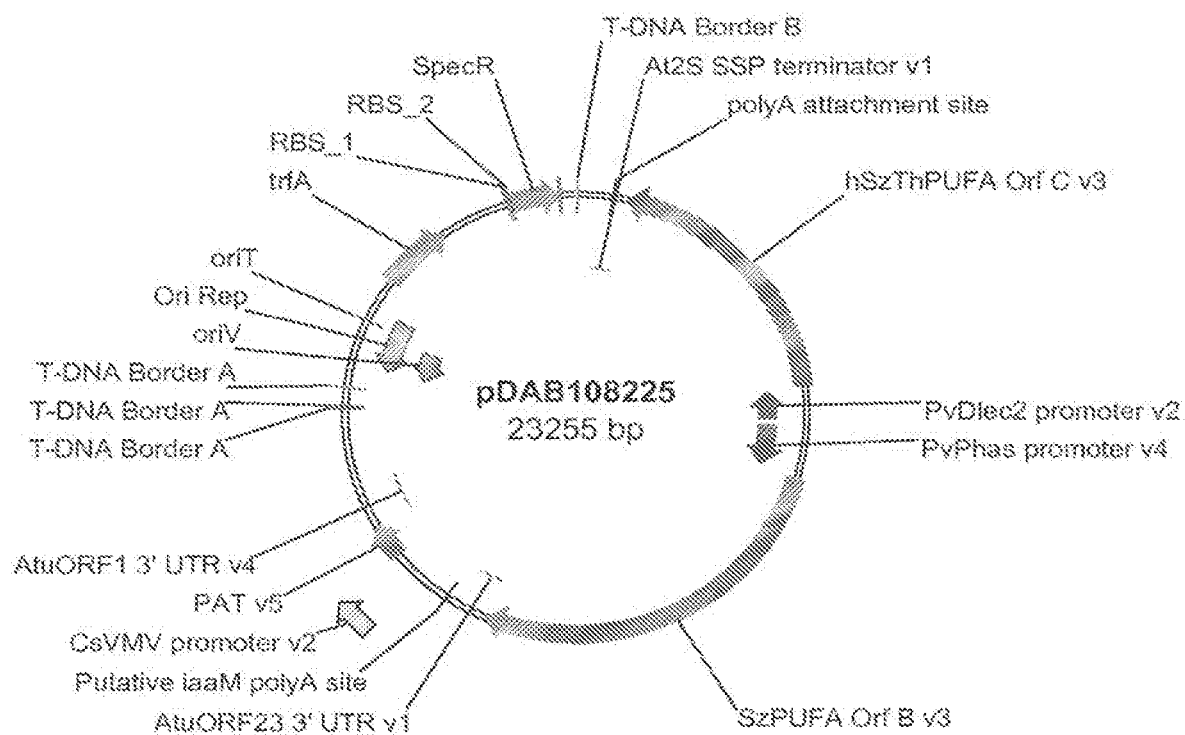
FIG. 50 shows the plasmid map of pDAB108225.

The pDAB108225 plasmid (FIG. 50; SEQ ID NO:70) was constructed using a multi-site Gateway L-R recombination reaction. pDAB108225 contains two PUFA synthase PTUs and a phosphinothricin acetyl transferase PTU. Specifically, the first PUFA synthase PTU contains the PvDlec2 promoter v2, 2S 5' UTR, SzPUFA OrfB v3 and At2S SSP terminator v1. The second PUFA synthase PTU contains the PvPhas promoter v4, SzPUFA OrfB v3 and Atu ORF23 3' UTR v1.

Plasmids pDAB108217, pDAB108222 and pDAB7333 were recombined to form pDAB108225. Specifically, the SzPUFA OrfB v3 and hSzThPUFA OrfC v3 are placed in a head-to-head orientation within the T-strand DNA border regions of the plant transformation binary pDAB7333. The order of the genes is: SzPUFA OrfB v3, hSzThPUFA OrfC v3. pDAB7333 also contains the phosphinothricin acetyl transferase PTU: CsVMV promoter v2, PAT v5, AtuORF1 3'UTR v4 in addition to other regulatory elements such as Overdrive and T-stand border sequences (T-DNA Border A and T-DNA Border B). Recombinant plasmids containing the five PTUs were then isolated and tested for incorporation of the three PTUs with restriction enzyme digestion and DNA sequencing.

Canola Transformation with Constructs Containing Alternative Designs

These plasmids are used to stably transform canola plants using the protocols described above. Transgenic canola plants are isolated and molecularly characterized. The use of alternative constructs result in canola plants which contain greater amounts of DHA and LC-PUFAs. The resulting LC-PUFA accumulation is determined and canola plants which produce 0.01% to 15% DHA or 0.01% to 15% LC-PUFA are identified.

Example 18

Alternative Construct Designs Used for Transformation of *Arabidopsis thaliana* and Subsequent Production of LC-PUFA and DHA

Figure 51:
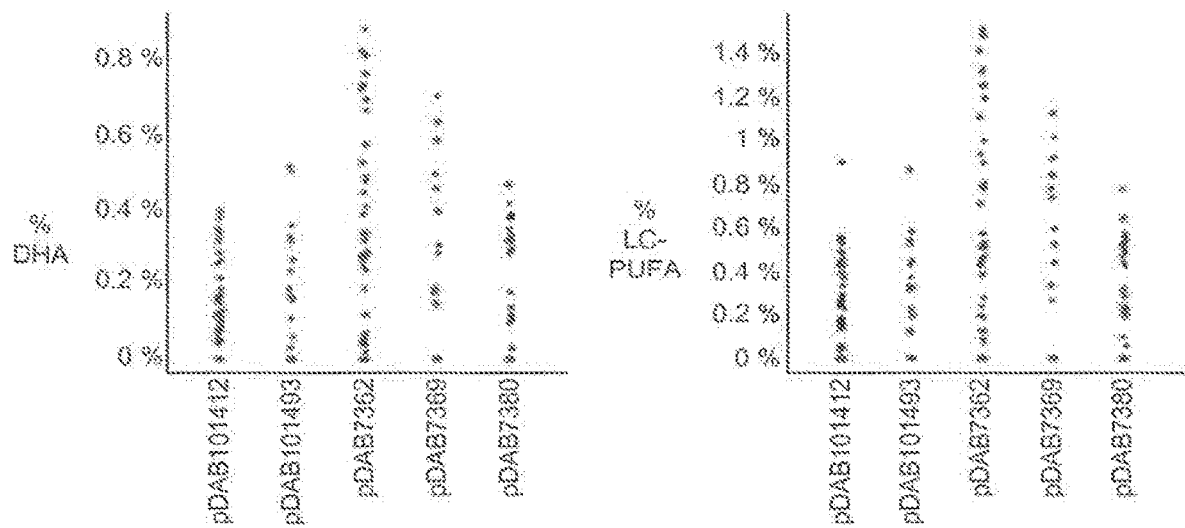
FIG. 51 illustrates DHA and LC-PUFA content of $T_2$ seed from individual transgenic *Arabidopsis* events transformed with pDAB101493, pDAB7362, pDAB7369, pDAB101412 or pDAB7380.

*Arabidopsis thaliana* plants were transformed with *Agrobacterium tumefaciens* strains containing the pDAB101493, pDAB7362, pDAB7369, pDAB101412, or pDAB7380 binary vectors. A floral dipping transformation protocol described by Clough and Bent (1998) was used for the transformation. Clough and Bent, "Floral dip: a simplified method for *agrobacterium*-mediated transformation of *Arabidopsis thalia*," Plant J., 16:735-743, 1998. Transformed *Arabidopsis* plants were obtained and molecular confirmation of the transgene presence was completed. $T_1$ plants from the transgenic *Arabidopsis* events were grown to maturity in the greenhouse. These plants were self-fertilized and the resulting $T_2$ seed harvested at maturity. Single seeds were analyzed via FAMEs GC-FID to determine the LC-PUFA and DHA content in the $T_2$ *Arabidopsis* seed. The tissue was analyzed via the FAMEs GC-FID method as described in the previous examples. Single $T_2$ seeds from a $T_1$ plant of the *Arabidopsis* plants contained from 0.00% to 0.95% DHA and 0.00% to 1.50% total LC-PUFA. The LC-PUFA and DHA content of each $T_2$ seed from the individual $T_1$ plants is shown in FIG. 51.

Example 19

Transformation of a "Non-High Oleic" Canola Variety (DH12075) with the PUFA Synthase Gene Set

*Brassica napus* variety DH12075 was transformed by the hypocotyl transformation method essentially as described in Example 4 using *Agrobacterium tumefaciens* harboring plasmid pDAB7362. Unlike the Nexera 710 genetic background, DH12075 is not a "high oleic" variety. $T_0$ DH12075 plants that were positive for the presence of the pat gene were recovered and analyzed for presence of all five of the DHA gene set (PUFA synthase OrfA, PUFA synthase OrfB, PUFA synthase chimeric OrfC, acyl-CoA synthetase and 4' phosphopantetheinyl transferase HetI) by the molecular analysis methods described in Example 5. Event 001-2009-006DH (Event 006) was identified as a $T_0$ plant containing all five DHA genes. It was grown to maturity in the growth chamber and T₁ seed harvested. Analysis of single T₁ seeds of Event 006 by the methods described in Example 6 showed that 31 of 48 seeds analyzed contained DHA with levels between 0.19% and 0.86% DHA. 113 T₁ seeds were planted, grown in growth chamber and leaf tissue samples analyzed by the methods described in Example 4 to determine the zygosity of individual plants. 23 plants were determined by qPCR analysis to be homozygous for the PAT gene and also showed cosegregation of the five DHA genes, indicating the presence of a single locus. Southern analysis of Event 006 T₁ plant tissue using pat and OrfA probes indicated that there was one additional copy of the OrfA gene present. The homozygous plants were grown to maturity and seed harvested. FAME analysis of bulk T₂ seed samples from each of these plants showed that 17 of 23 homozygous T₂ plants produced LC-PUFAs with DHA contents between 0.17 and 0.72%. Five T₂ seed samples contained EPA between 0.08% and 0.16%, and the total LC-PUFA (DHA+EPA+DPA[n-6]) of the LC-PUFA-producing events was between 0.33% and 1.35%. Table 22a shows the complete fatty acid profile of two of the DHA-containing bulk T₂ samples of Event 006. Single seed analysis was performed on 48 individual T₂ seeds from eight of the homozygous T₁ lines and the average DHA content of these seeds are shown in Table 23. Single T₂ seeds with DHA content of up to 1.31% were detected. Table 22b shows the complete fatty acid profile of four DHA-containing T₂ seeds. These data show that DHA can be produced in canola with genetic backgrounds having oleic acid contents of less than 72% via transformation with the PUFA synthase gene set.

TABLE 23

Average DHA content of T₂ seeds from eight homozygous Event 006 T₁ canola plants in the DH12075 genetic background (48 seeds per plant were analyzed).

| T₁ plant ID | Average DHA content | Average Total LC-PUFA content | Minimum DHA content | Maximum DHA content |
|---|---|---|---|---|
| Event 006-002 | 0.68% | 1.26% | 0.00% | 1.01% |
| Event 006-004 | 0.52% | 0.91% | 0.00% | 1.30% |
| Event 006-019 | 0.55% | 0.96% | 0.00% | 1.15% |
| Event 006-012 | 0.32% | 0.57% | 0.00% | 1.31% |
| Event 006-014 | 0.68% | 1.28% | 0.00% | 0.91% |
| Event 006-026 | 0.00% | 0.00% | 0.00% | 0.00% |
| Event 006-033 | 0.78% | 1.39% | 0.00% | 1.31% |
| Event 006-037 | 0.47% | 0.85% | 0.00% | 1.01% |

The foregoing description of the invention has been presented for purposes of illustration and description. Furthermore, the description is not intended to limit the invention to the form disclosed herein.

All of the various aspects, embodiments, and options described herein can be combined in any and all variations.

All publications, patents, and patent applications mentioned in this specification are herein incorporated by reference to the same extent as if each individual publication, patent, or patent application was specifically and individually indicated to be incorporated by reference:

TABLE 22

Complete FAME profiles of T₂ seeds from Event 006 in DH12075 genetic background

| | C14:0 | C16:0 | C16:1 | C18:0 | C18:1 | C18:1 (n-7) | C18:2 | C18:3 |
|---|---|---|---|---|---|---|---|---|
| a. Bulk T2 seed analysis | | | | | | | | |
| Event 006-033 | 0.08 | 3.51 | 0.14 | 2.49 | 70.21 | 1.27 | 11.39 | 6.36 |
| Event 006-002 | 0.08 | 3.99 | 0.16 | 2.10 | 69.52 | 1.28 | 12.56 | 5.85 |
| b. Single T2 seed analysis | | | | | | | | |
| Event 006-019 #32 | 0.00 | 3.88 | 0.28 | 2.42 | 68.75 | 0.00 | 13.43 | 5.88 |
| Event 006-012 #7 | 0.00 | 3.53 | 0.18 | 3.55 | 68.41 | 2.24 | 11.04 | 5.11 |
| Event 006-033 #43 | 0.00 | 3.22 | 0.31 | 3.17 | 71.02 | 1.69 | 8.57 | 5.25 |
| Event 006-004 #20 | 0.00 | 4.02 | 0.26 | 0.95 | 46.04 | 3.13 | 27.43 | 12.75 |

| | C20:0 | C20:1 | C22:0 | C22:1 | C20:5 | C24:0 | C22:5 (n-6) | C22:6 |
|---|---|---|---|---|---|---|---|---|
| a. Bulk T2 seed analysis | | | | | | | | |
| Event 006-033 | 0.81 | 1.31 | 0.40 | 0.23 | 0.15 | 0.32 | 0.64 | 0.70 |
| Event 006-002 | 0.85 | 1.35 | 0.52 | 0.00 | 0.00 | 0.39 | 0.63 | 0.72 |
| b. Single T2 seed analysis | | | | | | | | |
| Event 006-019 #32 | 0.93 | 1.19 | 0.61 | 0.00 | 0.00 | 0.72 | 0.77 | 1.15 |
| Event 006-012 #7 | 1.05 | 1.43 | 0.41 | 0.25 | 0.00 | 0.49 | 1.00 | 1.31 |
| Event 006-033 #43 | 1.00 | 1.26 | 0.62 | 0.00 | 0.00 | 1.44 | 1.15 | 1.31 |
| Event 006-004 #20 | 0.72 | 1.23 | 0.49 | 0.00 | 0.00 | 0.87 | 0.80 | 1.30 |

SEQUENCE LISTING (87 sequences)

SEQ ID NO: 1 - protein, 2910 aa, Schizochytrium sp. ATCC_20888
  SzPUFA OrfA v3 protein
  ref <308>: DATABASE ACCESSION NUMBER: GenBank AF378327
  ref <309>: DATABASE ENTRY DATE: 2007-10-22
MAARLQEQKGGEMDTRIAIIGMSAILPCGTTVRESWETIRAGIDCLSDLPEDRVDVTAYFDPVKTTKDKIYCKRGGFIPEYDFDAREFGLNMFQMEDSDANQTISLLKVKEALQDAGIDALGKEKKNIGCVLGIGGGQKSSHEFYSRLNYVVVEKVLRKMGMPEEDVKVAVEKYKANFPEWRLDSFPGFLGNVTAGRCTNTFNLDGMNCVVDAACASSLIAVKVAIDELLYGDCDMMVTGATCTDNSIGMYMAFSKTPVFSTDPSVRAYDEKTKGMLIGEGSAMLVLKRYADAVRDGDEIHAVIRGCASSSDGKAAGIYTPTISGQEEALRRAYNRACVDPATVTLVEGHGTGTPVGDRIELTALRNLFDKAYGEGNTEKVAVGSIKSSIGHLKAVAGLAGMIKVIMALKHKTLPGTINVDNPPNLYDNTPINESSLYINTMNRPWFPPPGVPRRAGISSFGFGGANYHAVLEEAEPEHTTAYRLNKRPQPVLMMAATPAALQSLCEAQLKEFEAAIKENETVKNTAYIKCVKFGEQFKFPGSIPATNARLGFLVKDAEDACSTLRAICAQFAKDVTKEAWRLPREGVSFRAKGIATNGAVAALFSGQGAQYTHMFSEVAMNWPQFRQSIAAMDAAQSKVAGSDKDFERVSQVLYPRKPYEREPEQDHKKISLTAYSQPSTLACALGAFEIFKEAGFTPDFAAGHSLGEFAALYAAGCVDRDELFELVCRRARIMGGKDAPATPKGCMAAVIGPNAENIKVQAANVWLGNSNSPSQTVITGSVEGIQAESARLQKEGFRVVPLACESAFHSPQMENASSAFKDVISKVSFRTPKAETKLFSNVSGETYPTDAREMLTQHMTSSVKFLTQVRNMHQAGARIFVEFGPKQVLSKLVSETLKDDPSVVTVSVNPASGTDSDIQLRDAAVQLVVAGVNLQGFDKWDAPDATRMQAIKKKRTTLRLSAATYVSDKTKKVRDAAMNDGRCVTYLKGAAPLIKAPEPVVDEAAKREAERLQKELQDAQRQLDDAKRAAAEANSKLAAAKEEAKTAAASAKPAVDTAVVEKHRAILKSMLAELDGYGSVDASSLQQQQQQQTAPAPVKAAAPAAPVASAPAPAVSNELLEKAETVVMEVLAAKTGYETDMIEADMELETELGIDSIKRVEILSEVQAMLNVEAKDVDALSRTRTVGEVVNAMKAEIAGSSAPAPAAAAPAPAKAAPAAAAPAVSNELLEKAETVVMEVLAAKTGYETDMIESDMELETELGIDSIKRVEILSEVQAMLNVEAKDVDALSRTRTVGEVVNAMKAEIAGGSAPAPAAAAPGPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAPAAPAPAVSSELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAPAAPAPAAPAPAVSSELLEKAETVVMEVLAAKTGYETDMIESDMELETELGIDSIKRVEILSEVQAMLNVEAKDVDALSRTRTVGEVVDAMKAEIAGSSASAPAAAAPAPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGSSAPAPAAAAPAPAAAAPAPAAAAPAVSSELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGGSAPAPAAAAPASAGAAPAVKIDSVHGADCDDLSLMHAKVVDIRRPDELILERPENRPVLVVDDGSELTLALVRVLGACAVVLTFEGLQLAQRAGAAAIRHVLAKDLSAESAEKAIKEAEQRFGALGGFISQQAERFEPAEILGFTLMCAKFAKASLCTAVAGGRPAFIGVARLDGRLGFTSQGTSDALKRAQRGAIFGLCKTIGLEWSESDVFSRGVDIAQGMHPEDAAVAIVREMACADIRIREVGIGANQQRCTIRAAKLETGNPQRQIAKDDVLLVSGGARGITPLCIREITRQIAGGKYILLGRSKVSASEPAWCAGITDEKAVQKAATQELKRAFSAGEGPKPTPRAVTKLVGSVLGAREVRSSIAAIEALGGKAIYSSCDVNSAADVAKAVRDAESQLGARVSGIVHASGVLRDRLIEKKLPDEFDAVFGTKVTGLENLLAAVDRANLKHMVLFSSLAGFHGNVGQSDYAMANEALNKMGLELAKDVSVKSICFGPWDGGMVTPQLKKQFQEMGVQIIPREGGADTVARIVLGSSPAEILVGNWRTPSKKVGSDTITLHRKISAKSNPFLEDHVIQGRRVLPMTLAIGSLAETCLGLFPGYSLWAIDDAQLFKGVTVDGDVNCEVTLTPSTAPSGRVNVQATLKTFSSGKLVPAYRAVIVLSNQGAPPANATMQPPSLDADPALQGSVYDGKTLFHGPAFRGIDDVLSCTKSQLVAKCSAVPGSDAARGEFATDTDAHDPFVNDLAFQAMLVWVRRTLGQAALPNSIQRIVQHRPVPQDKPFYITLRSNQSGGHSQHKHALQFHNEQGDLFIDVQASVIATDSLAF

SEQ ID NO: 2 - protein, 2059 aa, Schizochytrium sp. ATCC_20888
  SzPUFA OrfB v3 protein
  ref <308>: DATABASE ACCESSION NUMBER: GenBank: AF378328
  ref <309>: DATABASE ENTRY DATE: 2007-10-22
MAARNVSAAHEMHDEKRIAVVGMAVQYAGCKTKDEFWEVLMNGKVESKVISDKRLGSNYRAEHYKAERSKYADTFCNETYGTLDENEIDNEHELLLNLAKQALAETSVKDSTRCGIVSGCLSFPMDNLQGELLNVYQNHVEKKLGARVFKDASHWSEREQSNKPEAGDRRIFMDPASFVAEELNLGALHYSVDAACATALYVLRLAQDHLVSGAADVMLCGATCLPEPFFILSGFSTFQAMPVGTGQNVSMPLHKDSQGLTPGEGGSIMVLKRLDDAIRDGDHIYGTLLGANVSNSGTGLPLKPLLPSEKKCLMDTYTRINVHPHKIQYVECHATGTPQGDRVEIDAVKACFEGKVPRFGTTKGNFGHTLVAAGFAGMCKVLLSMKHGIIPPTPGIDDETKMDPLVVSGEAIPWPETNGEPKRAGLSAFGFGGTNAHAVFEEHDPSNAACTGHDSISALSARCGGESNMRIAITGMDATFGALKGLDAFERAIYTGAHGAIPLPEKRWRFLGKDKDFLDLCGVKATPHGCYIEDVEVDFQRLRTPMTPEDMLLPQQLLAVTTIDRAILDSGMKKGGNVAVFVGLGTDLELYRHRARVALKERVRPEASKKLNDMMQYINDCGTSTSYTSYIGNLVATRVSSQWGFTGPSFTITEGNNSVYRCAELGKYLLETGEVDGVVVAGVDLCGSAENLYVKSRRFKVSTSDTPRASFDAAADGYFVGEGCGAFVLKRETSCTKDDRIYACMDAIVPGNVPSACLREALDQARVKPGDIEMLELSADSARHLKDPSVLPKELTAEEEIGGLQTILRDDDKLPRNVATGSVKATVGDTGYASGAASLIKAALCIYNRYLPSNGDDWDEPAPEAPWDSTLFACQTSRAWLKNPGERRYAAVSGVSETRSCYSVLLSEAEGHYERENRISLDEEAPKLIVLRADSHEEILGRLDKIRERFLQPTGAAPRESELKAQARRIFLELLGETLAQDAASSGSQKPLALSLVSTPSKLQREVELAAKGIPRCLKMRRDWSSPAGSRYAPEPLASDRVAFMYGEGRSPYYGITQDIHRIWPELHEVINEKTNRLWAEGDRWVMPRASFKSELESQQQEFDRNMIEMFRLGILTSIAFTNLARDVLNITPKAAFGLSLGEISMIFAFSKKNGLISDQLTKDLRESDVWNKALAVEFNALREAWGIPQSVPKDEFWQGYIVRGTKQDIEAAIAPDSKYVRLTIINDANTALISGKPDACKAAIARLGGNIPALPVTQGMCGHCPEVGPYTKDIAKIHANLEFPVVDGLDLWTTINQKRLVPRATGAKDEWAPSSFGEYAGQLYEKQANFPQIVETIYKQNYDVFVEVGPNNHRSTAVRTTLGPQRNHLAGAIDKQNEDAWTTIVKLVASLKAHLVPGVTISPLYHSKLVAEAEACYAALCKGEKPKKNKFVRKIQLNGRFNSKADPISSADLASFPPADPAIEAAISSRIMKPVAPKFYARLNIDEQDETRDPILNKDNAPSSSSSSSSSSSSSSSPSPAPSAPVQKKAAPAAETKAVASADALRSALLDLDSMLALSSASASGNLVETAPSDASVIVPPCNIADLGSRAFMKTYGVSAPLYTGAMAKGIASADLVIAAGRQGILASFGAGGLPMQVVRESIEKIQAALPNGPYAVNLIHSPFDSNLEKGNVDLFLEKGVTFVEASAFMTLTPQVVRYRAAGLTRNADGSVNIRNRIIGKVSRTELAEMFMRPAPEHLLQKLIASGEINQEQAELARRVPVADDIAVEADSGGHTDNRPIHVILPLIINLRDRLHRECGYPANLRVRVGAGGGIGCPQAALATFNMGASFIVTGTVNQVAKQSGTCDNVRKQLAKATYSDVCMAPAADMFEEGVKLQVLKKGTMFPSRANKLYELFCKYDSFESMPPAELARVEKRIFSRALEEVWDETKNFYINRLHNPEKIQRAERDPKLKMSLCFRWYLSLASRWANTGASDRVMDYQVWCGPAIGSFNDFIKGTYLDPAVANEYPCVVQINKQILRGACFLRRLEILRNARLSDGAAALVASIDDTYVPAEKL

SEQ ID NO: 3 - protein, 1493 aa, Artificial sequence
  Chimeric PUFA OrfC from Schizochytrium sp. ATCC_20888 and Thraustochytrium
  hSzThPUFA OrfC v3 protein
  ref <302>: TITLE: CHIMERIC PUFA POLYKETIDE SYNTHASE SYSTEMS AND USES THEREOF
  ref <310>: PATENT DOCUMENT NUMBER: US 2008-0022422 A1
  ref <311>: PATENT FILING DATE: 2007-05-16
  ref <312>: PUBLICATION DATE: 2008-01-24
MALRVKTNKKPCWEMTKEELTSGKTEVFNYEELLEFAEGDIAKVFGPEFAVIDKYPRRVRLPAREYLLVTRVTLMDAEVNNYRVGARMVTEYDLPVNGELSEGGDCPWAVLVESGQCDLMLISYMGIDFQNQGDRVYRLLNTTLTFYGVAHEGETLEYDIRVTGFAKRLDGGISMFFFEYDCYVNGRLLIEMRDGCAGFFTNEELDAGKGVVFTRGDLAARAKIPKQDVSPYAVAPCLHKTKLNEKEMQTLVDKDWASVFGSKNGMPEINYKLCARKMLMIDRVTSIDHKGGVYGLGQLVGEKILERDHWYFPCHFVKDQVMAGSLVSDGCSQMLKMYMIWLGLHLTTGPFDFRPVNGHPNKVRCRGQISPHKGKLVYVMEIKEMGFDEDNDPYAIADVNIIDVDFEKGQDFSLDRISDYGKGDLNKKIVVDFKGIALKMQKRSTNKNPSKVQPVFANGAATVGPEASKASSGASASASAAPAKPAFSADVLAPKPVALPEHILKGDALAPKEMSWHPMSKLPGNPTPFFSPSSYPPRAICFIPFPGNPLDNNCKAGEMPLNWYNMSEFMCGKVSNCLGPEFARFDKSNTSRSPAFDLALVTRVVEVTNMEHGKFLNVDCNPSKGTMVGEFDCPQDAWFFDGSCNDGHMPYSIIMEIGLQTSGVLTSVLKAPLTMDKDDILFRNLDASAEMVRPDVDVRGKTIRNVTKCTGYAMLGKMGIHRFTFELSVDGVVFYKGSTSFGWFTPEVFAQQAGLDNGKKTEPWCKTNNTSVRRVEIASAKGKEQLTEKLPDATNAQVLRRSEQCEYLDYLNIAPDSGLHGKGYAHGHKDVNPQDWFFSCHFWFDPVMPGSLGIESMFQLIEAFAVDQNIPGEYNVSNPTFAHAPGKTAWKYRGQLTPKNRAMDCEVHIVSITASPENGGYVDIVADGALWVDGLRVYEAKELRVRVVSAKPQAIPDVQQQPPSAKADPGKTGVALSPTQLRDVLLEVDNPLYLGVENSNLVQFESKPATSSRIVSIKPCSISDLGDKSFMETYNVSAPLYTGAMAKGIASADLVIAAGKRKILGSFGAGGLPMHHVRAALEKIQAALPQGPYAVNLIHSPFDSNLEKGNVDLFLEKGVTVVEASAFMTLTPQVVRYRAAGLSRNADGSVNIRNRIIGKVSRTELAEMFIRPAPEHLLEKLIASGEITQEQAELARRVPVADDIAVEADSGGHTDNRPIHVILPLIINLRNRLHRECGYPAHLRVRVGAGGGVGCPQAAAAALTMGAAFIVTGTVNQVAKQSGTCDNVRKQLSQATYSDICMAPAADMFEEGVKLQVLKKGTMFPSRANKLYELFCKYDSFDSMPPAELERIEKRIFKRALQEVWEETKDFYINGLKNPEKIQRAEHDPKLKMSLCFRWYLGLASRWANMGAPDRVMDYQVWCGPAIGAFNDFIKGTYLDPAVSNEYPCVVQINLQILRGACYLRRLNALRNDPRIDLETEDAAFVYEPTNAL

SEQ ID NO: 4 - protein, 780 aa, Schizochytrium sp. ATCC_20888
  SzACS-2 v3 protein
  ref <302>: TITLE: POLYUNSATURATED FATTY ACID PRODUCTION IN HETEROLOGOUS ORGANISMS USING PUFA POLYKETIDE SYNTHASE SYSTEMS
  ref <310>: PATENT DOCUMENT NUMBER: US 2007-0245431 A1
  ref <311>: PATENT FILING DATE: 2007-03-15
  ref <312>: PUBLICATION DATE: 2007-10-18
MPTPDATAPLNKPSDYAVYHEEDGPFWTADSSGVSRVNFSETGVGSEGVIPALTLIDVFERAVKRGGNRIAFRTENMPTLRRGEEAPDALPLKDWKSWSWKQYKADVHRIARALMDLGVEQHDAVSIFGFNSPEWFLSAVGAVHAGAKIAGIYPSDTPAQVQYKAFHSDTAVAVVENEQCFKKFAEVVEDLPYLKAIVCWDYEATDITREDGSVVEVLTFAEFLKRGDTVEAAALDERISKIEPTMCAALIYTSGTTGRPKAVMISHDNLVFEASAVVPNLGGACTTTAEERILSYLPLSHVAGMMVDIIAPIIATAFHKGRICVCFARPYDLRTGTLGQRLNAVEPTIFLGVPRVWEKIQEKLMAVGAKTTGLKKKLSTAAKKRGLEFQEEQQIGRSGANPGFGPLGIYKKLLGLIKGKLGLTKCKFAFAGAAPMTRETLQYFGALNININEVYGMSECSGAATWSTDKAHEWGTVGYEMPSCEVRVFKIAEDGTKTECPRAADIMHATEEEQGEVCFRGRNIMMGYLANPKLGDDHVAEIEEKNAAAIDSEGWLHSGDKGAISTRGMLKITGRYKELIIGAGGENVAPVPIEDAIKARMPFVSNAMMVGDKRKFMAVLLTLKTVGATGELPGTNKLMGAAADYGETIEDACDNEALIEEITQQLKEIGDDGDVTPSNAARIQKFTILPLDFSVSTDELTATLKLKRSVVADKYEDIIEAFYESKSVFVPYSTVGAYATGGPVDDSVVDGSFKGDFSMIGDDDPDLQNVDVLEAIDEDN

SEQ ID NO: 5 - protein, 237 aa, Nostoc sp. PCC 7120
  NoHetI v3 protein
  ref <308>: DATABASE ACCESSION NUMBER: GenBank: P37695
  ref <309>: DATABASE ENTRY DATE: 1994-10-01
MLQHTWLPKPPNLTLLSDEVHLWRIPLDQPESQLQDLAATLSSDELARANRFYFPEHRRRFTAGRGILRSILGGYLGVEPGQVKFDYESRGKPILGDRFAESGLLFNLSHSQNLALCAVNYTRQIGIDLEYLRPTSDLESLAKRFFLPREYELLRSLPDEQKQKIFFRYWTCKEAYLKATGDGIAKLEEIEIALTPTEPAKLQTAPAWSLLELVPDDNCVAAVAVAGFGWQPKFWHY

SEQ ID NO: 6 - DNA, 8733 bp, Schizochytrium sp. ATCC_20888
  SzPUFA OrfA v3 gene
  ref <308>: DATABASE ACCESSION NUMBER: GenBank: AF378327
  ref <309>: DATABASE ENTRY DATE: 2007-10-22
atggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctga

SEQ ID NO: 7 - DNA, 6180 bp, Schizochytrium sp. ATCC_20888
  SzPUFA OrfB v3 gene
  ref <308>: DATABASE ACCESSION NUMBER: GenBank: AF378328
  ref <309>: DATABASE ENTRY DATE: 2007-10-22
atggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtga

SEQ ID NO: 8 - DNA, 4482 bp, Artificial sequence
  Chimeric PUFA OrfC from Schizochytrium sp. ATCC_20888 and Thraustochytrium
  hSzThPUFA OrfC v3 gene
  ref <302>: TITLE: CHIMERIC PUFA POLYKETIDE SYNTHASE SYSTEMS AND USES THEREOF
  ref <310>: PATENT DOCUMENT NUMBER: US 2008-0022422 A1
  ref <311>: PATENT FILING DATE: 2007-05-16
  ref <312>: PUBLICATION DATE: 2008-01-24
atggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttga

SEQ ID NO: 9 - DNA, 2343 bp, Schizochytrium sp. ATCC_20888
  hSzThACS-2 v3 gene
  ref <302>: TITLE: POLYUNSATURATED FATTY ACID PRODUCTION IN HETEROLOGOUS ORGANISMS USING PUFA POLYKETIDE SYNTHASE SYSTEMS
  ref <310>: PATENT DOCUMENT NUMBER: US 2007-0245431 A1
  ref <311>: PATENT FILING DATE: 2007-03-15
  ref <312>: PUBLICATION DATE: 2007-10-18
atgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactga

SEQ ID NO: 10 - DNA, 714 bp, Nostoc sp. PCC 7120
  NoHetI v3 gene
  ref <308>: DATABASE ACCESSION NUMBER: GenBank: P37695
  ref <309>: DATABASE ENTRY DATE: 1994-10-01
atgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactga

SEQ ID NO: 11 - DNA, 240 bp, Arabidopsis thaliana
  Chloroplast targeting sequence from ribulose bisphosphate carboxylase small chain 1A
atggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaa

SEQ ID NO: 12 - DNA, 29 bp, Artificial sequence
  TQPATS primer
acaagagtggattgatgatctagagaggt

SEQ ID NO: 13 - DNA, 29 bp, Artificial sequence
  TQPATA primer
ctttgatgcctatgtgacacgtaaacagt

SEQ ID NO: 14 - DNA, 29 bp, Artificial sequence
  TQPATFQ primer
ggtgttgtggctggtattgcttacgctgg

SEQ ID NO: 15 - DNA, 23 bp, Artificial sequence
  HMGF primer
cctctctaccaccgtctcacatg

SEQ ID NO: 16 - DNA, 20 bp, Artificial sequence
  HMGR primer
gatctggccggactgtttca

SEQ ID NO: 17 - DNA, 25 bp, Artificial sequence
  HMG-HEX primer
cgctcctcagctaccacctcaacca

SEQ ID NO: 18 - DNA, 24 bp, Artificial sequence
  MAS480 primer
cgagttcggactcaacatgttcca

SEQ ID NO: 19 - DNA, 24 bp, Artificial sequence
  MAS554 primer
aaggttgacgccagcgacaacgag

SEQ ID NO: 20 - DNA, 24 bp, Artificial sequence
  MAS547 primer
aagtttggagttggcttctgcagc

SEQ ID NO: 21 - DNA, 24 bp, Artificial sequence
  MAS581 primer
tgagtttggtctcaacatgttcca

SEQ ID NO: 22 - DNA, 24 bp, Artificial sequence
  MAS556 primer
gatgcacgccaaggtggttgacat

SEQ ID NO: 23 - DNA, 24 bp, Artificial sequence
  MAS481 primer
taatgtagaagggcttgtcctgcg

SEQ ID NO: 24 - DNA, 24 bp, Artificial sequence
  MAS550 primer
gatgcacgcaaaggtggttgacat

SEQ ID NO: 25 - DNA, 24 bp, Artificial sequence
  MAS572 primer
tgatgtagaagggtttgtcttgtg

SEQ ID NO: 26 - DNA, 24 bp, Artificial sequence
  MAS482 primer
catgagatgcatgacgagaagagg

SEQ ID NO: 27 - DNA, 24 bp, Artificial sequence
  MAS483
tggcaacttggttcactgttccag

SEQ ID NO: 28 - DNA, 24 bp, Artificial sequence
  MAS488 primer
cgcttcgtgtcaagaccaacaaga

SEQ ID NO: 29 - DNA, 24 bp, Artificial sequence
  MAS489 primer
gcaccacgcaaaatctgaaggttg

SEQ ID NO: 30 - DNA, 24 bp, Artificial sequence
  MAS496 primer
gaacttctctgaaactggtgtggg

SEQ ID NO: 31 - DNA, 24 bp, Artificial sequence
  MAS497
tcacaggcatcctcaatggtctca

SEQ ID NO: 32 - DNA, 24 bp, Artificial sequence
  MAS500 primer
tcagatgaggttcatctctggagg

SEQ ID NO: 33 - DNA, 24 bp, Artificial sequence
  MAS501 primer
atctggcacaagctccaacagaga

SEQ ID NO: 34 - DNA, 2346 bp, Artificial sequence
  SzACS-2 v4
atggctcccactcccgacgccaccgcgcctctgaacaagccgagcgactatgccgtctaccacgaggaagacggccccttctggaccgccgattccagcggcgtctcgcgcgtgaactttagcgagaccggcgtgggatccgagggcgtcatccctgcgctcacgctcatcgacgtcttcgagagggccgtcaagcgcggcggaaacaggatcgccttccgcacggaaaacatgcccacgctccgccgcggcgaagaggccccggacgcgctgccgctcaaggactggaagtcctggtcctggaaacagtacaaggccgacgtccaccgcatcgccagggctctcatggacctcggcgttgagcagcacgacgccgtctcgatttttggctttaactcgcccgaatggtttctcagtgccgtcggcgccgtgcacgcaggtgccaagattgccggtatttacccctcagacacgcccgcccaggtccagtacaaggccttccacagtgacaccgctgttgccgttgtcgaaaacgagcagtgcttcaagaagttcgccgaggtcgtcgaggaccttccttacctcaaggccattgtttgctgggactatgaagccacagacatcacgcgcgaggacggctccgtcgtcgaggtcctcacctttgccgagttcctcaagcgcggcgacaccgtcgaggcggccgcccttgacgagcgcatctccaagatcgagcccaccatgtgcgctgcccttatttacaccagcggtactaccggccgccccaaggccgttatgatttcgcacgacaaccttgttttcgaggccagcgccgtcgtccccaacctcggaggagcctgtacgaccactgctgaggagcgcattctctcgtacctgcctctctcgcacgtcgctggtatgatggttgatattattgcccccatcattgccaccgccttccacaagggccgcatctgcgtctgctttgctcgcccgtacgatttgcgcaccggcacgctgggccagcgcctcaacgccgtggagcccaccatcttccttggcgtgccccgtgtgtgggaaaagattcaggaaaagctcatggccgtcggtgccaaaaccaccggcctcaagaagaagctctctacggccgccaagaagcgtggtcttgaattccaggaggagcagcaaatcggccgctccggtgccaaccctggctttggcccccttggcatctacaagaagctcctcggcctcatcaagggcaagctgggcctcaccaagtgcaagtttgcctttgctggtgccgcgcccatgacccgtgagacccttcagtactttggcgcgctgaacatcaacattaacgaggtctacggcatgtcagagtgctccggtgccgccacctggtccacggacaaggcccacgagtggggcactgttggctacgagatgcccagttgcgaggtccgcgtcttcaagattgccgaggacggtaccaagaccgagtgcccgcgcgccgccgacattatgcatgctaccgaggaggagcagggcgaagtttgcttccgcggccgtaacatcatgatgggctaccttgccaaccccaagcttggcgacgaccacgttgccgagatcgaggagaagaacgctgccgctatcgactccgagggctggctccacagtggtgataagggcgccatttctacccgcggcatgctcaagatcacgggccgctacaaggagctcatcatcggcgccggtggcgagaacgtggcgcccgtccctattgaggacgccatcaaggcgcgcatgccttttgtttccaacgccatgatggtcggagataagcgcaagttcatggctgtcctccttaccctcaagacggttggcgccacgggcgagcttcccggtacgaacaagctcatgggcgctgccgccgactacggtgagaccatcgaggacgcctgcgacaacgaggcgctcattgaggagatcacgcagcagctcaaggagatcggtgatgatggcgatgtcacgccctcgaacgcggctcgcatccaaaagttcaccattctcccgctcgacttttccgtctccacggacgagctcacggccacgctcaagctcaagcgctccgtggtcgcagacaagtacgaagacatcatcgaggccttttacgagtccaagagcgtttttgtgccgtactcgaccgttggcgcctacgccacgggcggcccggtcgacgactccgttgtcgatggctcattcaagggcgactttagcatgattggcgacgatgatccggatcttcaaaacgtcgatgtcctcgaggcgattgacgaggacaattaa

SEQ ID NO: 35 - DNA, 33034 bp, Artificial sequence
  Plasmid pDAB7361 T-strand
cagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctagctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcggcccgtctgcaggagcaaaagggaggcgagatggatacccgcattgccatcatcggcatgtcggccatcctcccctgcggcacgaccgtgcgcgagtcgtgggagaccatccgcgccggcatcgactgcctgtcggatctccccgaggaccgcgtcgacgtgacggcgtactttgaccccgtcaagaccaccaaggacaagatctactgcaagcgcggtggcttcattcccgagtacgactttgacgcccgcgagttcggactcaacatgttccagatggaggactcggacgcaaaccagaccatctcgcttctcaaggtcaaggaggccctccaggacgccggcatcgacgccctcggcaaggaaaagaagaacatcggctgcgtgctcggcattggcggcggccaaaagtccagccacgagttctactcgcgccttaattatgttgtcgtggagaaggtcctccgcaagatgggcatgcccgaggaggacgtcaaggtcgccgtcgaaaagtacaaggccaacttccccgagtggcgcctcgactccttccctggcttcctcggcaacgtcaccgccggtcgctgcaccaacaccttcaacctcgacggcatgaactgcgttgtcgacgccgcatgcgcctcgtccctcatcgccgtcaaggtcgccatcgacgagctgctctacggtgactgcgacatgatggtcaccggtgccacctgcacggataactccatcggcatgtacatggccttctccaagacccccgtgttctccacggaccccagcgtgcgcgcctacgacgaaaagacaaagggcatgctcatcggcgagggctccgccatgctcgtcctcaagcgctacgccgacgccgtccgcgacggcgatgagatccacgctgttattcgcggctgcgcctcctccagtgatggcaaggccgccggcatctacacgcccaccatttcgggccaggaggaggccctccgccgcgcctacaaccgcgcctgtgtcgacccggccaccgtcactctcgtcgagggtcacggcaccggtactcccgttggcgaccgcatcgagctcaccgccttgcgcaacctctttgacaaggcctacggcgagggcaacaccgaaaaggtcgctgtgggcagcatcaagtccagcatcggccatctcaaggccgtcgccggtctcgccggtatgatcaaggtcatcatggcgctcaagcacaagactctcccgggcaccatcaacgtcgacaacccacccaacctctacgacaacacgcccatcaacgagtcctcgctctacattaacaccatgaaccgcccctggttcccgccccctggtgtgccccgccgcgccggcatttcgagctttggctttggtggcgccaactaccacgccgtcctcgaggaggccgagcccgagcacacgaccgcgtaccgcctcaacaagcgcccgcagcccgtgctcatgatggccgccacgcccgcggccctccagtcgctctgcgaggcccagctcaaggagttcgaggccgccatcaaggagaacgagaccgtcaagaacaccgcctacatcaagtgcgtcaagttcggcgagcagttcaaattccctggctccatcccggccacaaacgcgcgcctcggcttcctcgtcaaggatgctgaggatgcctgctccaccctccgtgccatctgcgcccaattcgccaaggatgtcaccaaggaggcctggcgcctcccccgcgagggcgtcagcttccgcgccaagggcatcgccaccaacggcgctgtcgccgcgctcttctccggccagggcgcgcagtacacgcacatgtttagcgaggtggccatgaactggccccagttccgccagagcattgccgccatggacgccgcccagtccaaggtcgctggaagcgacaaggactttgagcgcgtctcccaggtcctctacccgcgcaagccgtacgagcgtgagcccgagcaggaccacaagaagatctccctcaccgcctactcgcagccctcgaccctggcctgcgctctcggtgcctttgagatcttcaaggaggccggcttcaccccggactttgccgccggccattcgctcggtgagttcgccgccctctacgccgcgggctgcgtcgaccgcgacgagctctttgagcttgtctgccgccgcgcccgcatcatgggcggcaaggacgcaccggccacccccaagggctgcatggccgccgtcattggccccaacgccgagaacatcaaggtccaggccgccaacgtctggctcggcaactccaactcgccttcgcagaccgtcatcaccggctccgtcgaaggtatccaggccgagagcgcccgcctccagaaggagggcttccgcgtcgtgcctcttgcctgcgagagcgccttccactcgccccagatggagaacgcctcgtcggccttcaaggacgtcatctccaaggtctccttccgcacccccaaggccgagaccaagctcttcagcaacgtctctggcgagacctaccccacggacgcccgcgagatgcttacgcagcacatgaccagcagcgtcaagttcctcacccaggtccgcaacatgcaccaggccggtgcgcgcatctttgtcgagttcggacccaagcaggtgctctccaagcttgtctccgagaccctcaaggatgacccctcggttgtcaccgtctctgtcaacccggcctcgggcacggattcggacatccagctccgcgacgcggccgtccagctcgttgtcgctggcgtcaaccttcagggctttgacaagtgggacgcccccgatgccacccgcatgcaggccatcaagaagaagcgcactaccctccgcctttcggccgccacctacgtctcggacaagaccaagaaggtccgcgacgccgccatgaacgatggccgctgcgtcacctacctcaagggcgccgcaccgctcatcaaggccccggagcccgttgtcgacgaggccgccaagcgcgaggccgagcgtctccagaaggagcttcaggatgcccagcgccagctcgacgacgccaagcgcgccgccgccgaggccaactccaagctcgccgctgccaaggaggaggccaagaccgccgctgcttcggccaagcccgcagttgacactgctgttgtcgaaaagcatcgtgccatcctcaagtccatgctcgcggagctcgatggctacggatcggtcgacgcttcttccctccagcagcagcagcagcagcagacggcccccgccccggtcaaggctgctgcgcctgccgcccccgttgcctcggcccctgccccggctgtctcgaacgagcttcttgagaaggccgagactgtcgtcatggaggtcctcgccgccaagaccggctacgagaccgacatgatcgaggctgacatggagctcgagaccgagctcggcattgactccatcaagcgtgtcgagatcctctccgaggtccaggccatgctcaatgtcgaggccaaggatgtcgatgccctcagccgcactcgcactgttggtgaggttgtcaacgccatgaaggccgagatcgctggcagctctgccccggcgcctgctgccgctgctccggctccggccaaggctgcccctgccgccgctgcgcctgctgtctcgaacgagcttctcgagaaggccgagaccgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgacgctctcagccgcactcgcactgtgggtgaggtcgtcaacgccatgaaggctgagatcgctggtggctctgccccggcgcctgccgccgctgccccaggtccggctgctgccgcccctgcgcctgccgccgccgcccctgctgtctcgaacgagcttcttgagaaggccgagaccgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgctgtctcgagcgagcttctcgagaaggccgagactgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgccgcccctgcgcctgctgtctcgagcgagcttctcgagaaggccgagactgtcgtcatggaggtcctcgccgccaagactggctacgagactgacatgattgagtccgacatggagctcgagaccgagctcggcattgactccatcaagcgtgtcgagattctctccgaggttcaggccatgctcaacgtcgaggccaaggacgtcgacgctctcagccgcactcgcactgttggtgaggtcgtcgatgccatgaaggctgagatcgctggcagctccgcctcggcgcctgccgccgctgctcctgctccggctgctgccgctcctgcgcccgctgccgccgcccctgctgtctcgaacgagcttctcgagaaagccgagactgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttctcgagaaggccgagactgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgatgctctcagccgcactcgcactgttggcgaggtcgtcgatgccatgaaggctgagatcgccggcagctccgccccggcgcctgccgccgctgctcctgctccggctgctgccgctcctgcgcccgctgccgctgcccctgctgtctcgagcgagcttctcgagaaggccgagaccgtcgtcatggaggtcctcgccgccaagactggctacgagactgacatgattgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttcttgagaaggccgagaccgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgacgctctcagccgcactcgcactgttggcgaggtcgtcgatgccatgaaggctgagatcgctggtggctctgccccggcgcctgccgccgctgctcctgcctcggctggcgccgcgcctgcggtcaagattgactcggtccacggcgctgactgtgatgatctttccctgatgcacgccaaggtggttgacatccgccgcccggacgagctcatcctggagcgccccgagaaccgccccgttctcgttgtcgatgacggcagcgagctcaccctcgccctggtccgcgtcctcggcgcctgcgccgttgtcctgacctttgagggtctccagctcgctcagcgcgctggtgccgctgccatccgccacgtgctcgccaaggatctttccgcggagagcgccgagaaggccatcaaggaggccgagcagcgctttggcgctctcggcggcttcatctcgcagcaggcggagcgcttcgagcccgccgaaatcctcggcttcacgctcatgtgcgccaagttcgccaaggcttccctctgcacggctgtggctggcggccgcccggcctttatcggtgtggcgcgccttgacggccgcctcggattcacttcgcagggcacttctgacgcgctcaagcgtgcccagcgtggtgccatctttggcctctgcaagaccatcggcctcgagtggtccgagtctgacgtcttttcccgcggcgtggacattgctcagggcatgcaccccgaggatgccgccgtggcgattgtgcgcgagatggcgtgcgctgacattcgcattcgcgaggtcggcattggcgcaaaccagcagcgctgcacgatccgtgccgccaagctcgagaccggcaacccgcagcgccagatcgccaaggacgacgtgctgctcgtttctggcggcgctcgcggcatcacgcctctttgcatccgggagatcacgcgccagatcgcgggcggcaagtacattctgcttggccgcagcaaggtctctgcgagcgaaccggcatggtgcgctggcatcactgacgagaaggctgtgcaaaaggctgctacccaggagctcaagcgcgcctttagcgctggcgagggccccaagcccacgccccgcgctgtcactaagcttgtgggctctgttcttggcgctcgcgaggtgcgcagctctattgctgcgattgaagcgctcggcggcaaggccatctactcgtcgtgcgacgtgaactctgccgccgacgtggccaaggccgtgcgcgatgccgagtcccagctcggtgcccgcgtctcgggcatcgttcatgcctcgggcgtgctccgcgaccgtctcatcgagaagaagctccccgacgagttcgacgccgtctttggcaccaaggtcaccggtctcgagaacctcctcgccgccgtcgaccgcgccaacctcaagcacatggtcctcttcagctcgctcgccggcttccacggcaacgtcggccagtctgactacgccatggccaacgaggcccttaacaagatgggcctcgagctcgccaaggacgtctcggtcaagtcgatctgcttcggtccctgggacggtggcatggtgacgccgcagctcaagaagcagttccaggagatgggcgtgcagatcatcccccgcgagggcggcgctgataccgtggcgcgcatcgtgctcggctcctcgccggctgagatccttgtcggcaactggcgcaccccgtccaagaaggtcggctcggacaccatcaccctgcaccgcaagatttccgccaagtccaaccccttcctcgaggaccacgtcatccagggccgccgcgtgctgcccatgacgctggccattggctcgctcgcggagacctgcctcggcctcttccccggctactcgctctgggccattgacgacgcccagctcttcaagggtgtcactgtcgacggcgacgtcaactgcgaggtgaccctcaccccgtcgacggcgccctcgggccgcgtcaacgtccaggccacgctcaagaccttttccagcggcaagctggtcccggcctaccgcgccgtcatcgtgctctccaaccagggcgcgcccccggccaacgccaccatgcagccgccctcgctcgatgccgatccggcgctccagggctccgtctacgacggcaagaccctcttccacggcccggccttccgcggcatcgatgacgtgctctcgtgcaccaagagccagcttgtggccaagtgcagcgctgtccccggctccgacgccgctcgcggcgagtttgccacggacactgacgcccatgaccccttcgtgaacgacctggcctttcaggccatgctcgtctgggtgcgccgcacgctcggccaggctgcgctccccaactcgatccagcgcatcgtccagcaccgcccggtcccgcaggacaagcccttctacattaccctccgctccaaccagtcgggcggtcactcccagcacaagcacgcccttcagttccacaacgagcagggcgatctcttcattgatgtccaggcttcggtcatcgccacggacagccttgccttctaaatctaaactaggccatggtgacttaaggtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatcactagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttga

SEQ ID NO: 36 - DNA, 33003 bp, Artificial sequence
  Plasmid pDAB7362 T-strand
cagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatcactagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttga

SEQ ID NO: 37 - DNA, 33951 bp, Artificial sequence
  Plasmid pDAB7363 T-strand
cagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatcactagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaacttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttga

SEQ ID NO: 38 - DNA, 105 bp, Artificial sequence
  Acyl-ACP Thioesterase Transit Peptide
atgcttaagctctcttgtaacgttaccaatcatcttcacacattctcattctttagcgattctagtctgttcatccctgtcaacagaaggactcttgctgtgtct

SEQ ID NO: 39 - DNA, 38811 bp, Artificial sequence
  plasmid pDAB7365
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctagctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcggcccgtctgcaggagcaaaagggaggcgagatggatacccgcattgccatcatcggcatgtcggccatcctcccctgcggcacgaccgtgcgcgagtcgtgggagaccatccgcgccggcatcgactgcctgtcggatctccccgaggaccgcgtcgacgtgacggcgtactttgaccccgtcaagaccaccaaggacaagatctactgcaagcgcggtggcttcattcccgagtacgactttgacgcccgcgagttcggactcaacatgttccagatggaggactcggacgcaaaccagaccatctcgcttctcaaggtcaaggaggccctccaggacgccggcatcgacgccctcggcaaggaaaagaagaacatcggctgcgtgctcggcattggcggcggccaaaagtccagccacgagttctactcgcgccttaattatgttgtcgtggagaaggtcctccgcaagatgggcatgcccgaggaggacgtcaaggtcgccgtcgaaaagtacaaggccaacttccccgagtggcgcctcgactccttccctggcttcctcggcaacgtcaccgccggtcgctgcaccaacaccttcaacctcgacggcatgaactgcgttgtcgacgccgcatgcgcctcgtccctcatcgccgtcaaggtcgccatcgacgagctgctctacggtgactgcgacatgatggtcaccggtgccacctgcacggataactccatcggcatgtacatggccttctccaagacccccgtgttctccacggaccccagcgtgcgcgcctacgacgaaaagacaaagggcatgctcatcggcgagggctccgccatgctcgtcctcaagcgctacgccgacgccgtccgcgacggcgatgagatccacgctgttattcgcggctgcgcctcctccagtgatggcaaggccgccggcatctacacgcccaccatttcgggccaggaggaggccctccgccgcgcctacaaccgcgcctgtgtcgacccggccaccgtcactctcgtcgagggtcacggcaccggtactcccgttggcgaccgcatcgagctcaccgccttgcgcaacctctttgacaaggcctacggcgagggcaacaccgaaaaggtcgctgtgggcagcatcaagtccagcatcggccatctcaaggccgtcgccggtctcgccggtatgatcaaggtcatcatggcgctcaagcacaagactctcccgggcaccatcaacgtcgacaacccacccaacctctacgacaacacgcccatcaacgagtcctcgctctacattaacaccatgaaccgcccctggttcccgccccctggtgtgccccgccgcgccggcatttcgagctttggctttggtggcgccaactaccacgccgtcctcgaggaggccgagcccgagcacacgaccgcgtaccgcctcaacaagcgcccgcagcccgtgctcatgatggccgccacgcccgcggccctccagtcgctctgcgaggcccagctcaaggagttcgaggccgccatcaaggagaacgagaccgtcaagaacaccgcctacatcaagtgcgtcaagttcggcgagcagttcaaattccctggctccatcccggccacaaacgcgcgcctcggcttcctcgtcaaggatgctgaggatgcctgctccaccctccgtgccatctgcgcccaattcgccaaggatgtcaccaaggaggcctggcgcctcccccgcgagggcgtcagcttccgcgccaagggcatcgccaccaacggcgctgtcgccgcgctcttctccggccagggcgcgcagtacacgcacatgtttagcgaggtggccatgaactggccccagttccgccagagcattgccgccatggacgccgcccagtccaaggtcgctggaagcgacaaggactttgagcgcgtctcccaggtcctctacccgcgcaagccgtacgagcgtgagcccgagcaggaccacaagaagatctccctcaccgcctactcgcagccctcgaccctggcctgcgctctcggtgcctttgagatcttcaaggaggccggcttcaccccggactttgccgccggccattcgctcggtgagttcgccgccctctacgccgcgggctgcgtcgaccgcgacgagctctttgagcttgtctgccgccgcgcccgcatcatgggcggcaaggacgcaccggccacccccaagggctgcatggccgccgtcattggccccaacgccgagaacatcaaggtccaggccgccaacgtctggctcggcaactccaactcgccttcgcagaccgtcatcaccggctccgtcgaaggtatccaggccgagagcgcccgcctccagaaggagggcttccgcgtcgtgcctcttgcctgcgagagcgccttccactcgccccagatggagaacgcctcgtcggccttcaaggacgtcatctccaaggtctccttccgcacccccaaggccgagaccaagctcttcagcaacgtctctggcgagacctaccccacggacgcccgcgagatgcttacgcagcacatgaccagcagcgtcaagttcctcacccaggtccgcaacatgcaccaggccggtgcgcgcatctttgtcgagttcggacccaagcaggtgctctccaagcttgtctccgagaccctcaaggatgacccctcggttgtcaccgtctctgtcaacccggcctcgggcacggattcggacatccagctccgcgacgcggccgtccagctcgttgtcgctggcgtcaaccttcagggctttgacaagtgggacgcccccgatgccacccgcatgcaggccatcaagaagaagcgcactaccctccgcctttcggccgccacctacgtctcggacaagaccaagaaggtccgcgacgccgccatgaacgatggccgctgcgtcacctacctcaagggcgccgcaccgctcatcaaggccccggagcccgttgtcgacgaggccgccaagcgcgaggccgagcgtctccagaaggagcttcaggatgcccagcgccagctcgacgacgccaagcgcgccgccgccgaggccaactccaagctcgccgctgccaaggaggaggccaagaccgccgctgcttcggccaagcccgcagttgacactgctgttgtcgaaaagcatcgtgccatcctcaagtccatgctcgcggagctcgatggctacggatcggtcgacgcttcttccctccagcagcagcagcagcagcagacggcccccgccccggtcaaggctgctgcgcctgccgcccccgttgcctcggcccctgccccggctgtctcgaacgagcttcttgagaaggccgagactgtcgtcatggaggtcctcgccgccaagaccggctacgagaccgacatgatcgaggctgacatggagctcgagaccgagctcggcattgactccatcaagcgtgtcgagatcctctccgaggtccaggccatgctcaatgtcgaggccaaggatgtcgatgccctcagccgcactcgcactgttggtgaggttgtcaacgccatgaaggccgagatcgctggcagctctgccccggcgcctgctgccgctgctccggctccggccaaggctgcccctgccgccgctgcgcctgctgtctcgaacgagcttctcgagaaggccgagaccgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgacgctctcagccgcactcgcactgtgggtgaggtcgtcaacgccatgaaggctgagatcgctggtggctctgccccggcgcctgccgccgctgccccaggtccggctgctgccgcccctgcgcctgccgccgccgcccctgctgtctcgaacgagcttcttgagaaggccgagaccgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgctgtctcgagcgagcttctcgagaaggccgagactgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgccgcccctgcgcctgctgtctcgagcgagcttctcgagaaggccgagactgtcgtcatggaggtcctcgccgccaagactggctacgagactgacatgattgagtccgacatggagctcgagaccgagctcggcattgactccatcaagcgtgtcgagattctctccgaggttcaggccatgctcaacgtcgaggccaaggacgtcgacgctctcagccgcactcgcactgttggtgaggtcgtcgatgccatgaaggctgagatcgctggcagctccgcctcggcgcctgccgccgctgctcctgctccggctgctgccgctcctgcgcccgctgccgccgcccctgctgtctcgaacgagcttctcgagaaagccgagactgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttctcgagaaggccgagactgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgatgctctcagccgcactcgcactgttggcgaggtcgtcgatgccatgaaggctgagatcgccggcagctccgccccggcgcctgccgccgctgctcctgctccggctgctgccgctcctgcgcccgctgccgctgcccctgctgtctcgagcgagcttctcgagaaggccgagaccgtcgtcatggaggtcctcgccgccaagactggctacgagactgacatgattgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttcttgagaaggccgagaccgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgacgctctcagccgcactcgcactgttggcgaggtcgtcgatgccatgaaggctgagatcgctggtggctctgccccggcgcctgccgccgctgctcctgcctcggctggcgccgcgcctgcggtcaagattgactcggtccacggcgctgactgtgatgatctttccctgatgcacgccaaggtggttgacatccgccgcccggacgagctcatcctggagcgccccgagaaccgccccgttctcgttgtcgatgacggcagcgagctcaccctcgccctggtccgcgtcctcggcgcctgcgccgttgtcctgacctttgagggtctccagctcgctcagcgcgctggtgccgctgccatccgccacgtgctcgccaaggatctttccgcggagagcgccgagaaggccatcaaggaggccgagcagcgctttggcgctctcggcggcttcatctcgcagcaggcggagcgcttcgagcccgccgaaatcctcggcttcacgctcatgtgcgccaagttcgccaaggcttccctctgcacggctgtggctggcggccgcccggcctttatcggtgtggcgcgccttgacggccgcctcggattcacttcgcagggcacttctgacgcgctcaagcgtgcccagcgtggtgccatctttggcctctgcaagaccatcggcctcgagtggtccgagtctgacgtcttttcccgcggcgtggacattgctcagggcatgcaccccgaggatgccgccgtggcgattgtgcgcgagatggcgtgcgctgacattcgcattcgcgaggtcggcattggcgcaaaccagcagcgctgcacgatccgtgccgccaagctcgagaccggcaacccgcagcgccagatcgccaaggacgacgtgctgctcgtttctggcggcgctcgcggcatcacgcctctttgcatccgggagatcacgcgccagatcgcgggcggcaagtacattctgcttggccgcagcaaggtctctgcgagcgaaccggcatggtgcgctggcatcactgacgagaaggctgtgcaaaaggctgctacccaggagctcaagcgcgcctttagcgctggcgagggccccaagcccacgccccgcgctgtcactaagcttgtgggctctgttcttggcgctcgcgaggtgcgcagctctattgctgcgattgaagcgctcggcggcaaggccatctactcgtcgtgcgacgtgaactctgccgccgacgtggccaaggccgtgcgcgatgccgagtcccagctcggtgcccgcgtctcgggcatcgttcatgcctcgggcgtgctccgcgaccgtctcatcgagaagaagctccccgacgagttcgacgccgtctttggcaccaaggtcaccggtctcgagaacctcctcgccgccgtcgaccgcgccaacctcaagcacatggtcctcttcagctcgctcgccggcttccacggcaacgtcggccagtctgactacgccatggccaacgaggcccttaacaagatgggcctcgagctcgccaaggacgtctcggtcaagtcgatctgcttcggtccctgggacggtggcatggtgacgccgcagctcaagaagcagttccaggagatgggcgtgcagatcatcccccgcgagggcggcgctgataccgtggcgcgcatcgtgctcggctcctcgccggctgagatccttgtcggcaactggcgcaccccgtccaagaaggtcggctcggacaccatcaccctgcaccgcaagatttccgccaagtccaaccccttcctcgaggaccacgtcatccagggccgccgcgtgctgcccatgacgctggccattggctcgctcgcggagacctgcctcggcctcttccccggctactcgctctgggccattgacgacgcccagctcttcaagggtgtcactgtcgacggcgacgtcaactgcgaggtgaccctcaccccgtcgacggcgccctcgggccgcgtcaacgtccaggccacgctcaagaccttttccagcggcaagctggtcccggcctaccgcgccgtcatcgtgctctccaaccagggcgcgcccccggccaacgccaccatgcagccgccctcgctcgatgccgatccggcgctccagggctccgtctacgacggcaagaccctcttccacggcccggccttccgcggcatcgatgacgtgctctcgtgcaccaagagccagcttgtggccaagtgcagcgctgtccccggctccgacgccgctcgcggcgagtttgccacggacactgacgcccatgaccccttcgtgaacgacctggcctttcaggccatgctcgtctgggtgcgccgcacgctcggccaggctgcgctccccaactcgatccagcgcatcgtccagcaccgcccggtcccgcaggacaagcccttctacattaccctccgctccaaccagtcgggcggtcactcccagcacaagcacgcccttcagttccacaacgagcagggcgatctcttcattgatgtccaggcttcggtcatcgccacggacagccttgccttctaaatctaaactaggccatggtgacttaaggtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctagctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggccgctcgcaacgtgtctgcagcgcatgagatgcacgatgaaaagcgcatcgccgtcgtcggcatggccgtccagtacgccggatgcaaaaccaaggacgagttctgggaggtgctcatgaacggcaaggtcgagtccaaggtgatcagcgacaaacgactcggctccaactaccgcgccgagcactacaaagcagagcgcagcaagtatgccgacaccttttgcaacgaaacgtacggcacccttgacgagaacgagatcgacaacgagcacgaactcctcctcaacctcgccaagcaggcactcgcagagacatccgtcaaagactcgacacgctgcggcatcgtcagcggctgcctctcgttccccatggacaacctccagggtgaactcctcaacgtgtaccaaaaccatgtcgagaaaaagctcggggcccgcgtcttcaaggacgcctcccattggtccgaacgcgagcagtccaacaaacccgaggccggtgaccgccgcatcttcatggacccggcctccttcgtcgccgaagaactcaacctcggcgcccttcactactccgtcgacgcagcatgcgccacggcgctctacgtgctccgcctcgcgcaggatcatctcgtctccggcgccgccgacgtcatgctctgcggtgccacctgcctgccggagccctttttcatcctttcgggcttttccaccttccaggccatgcccgtcggcacgggccagaacgtgtccatgccgctgcacaaggacagccagggcctcaccccgggtgagggcggctccatcatggtcctcaagcgtctcgatgatgccatccgcgacggcgaccacatctacggcacccttctcggcgccaatgtcagcaactccggcacaggtctgcccctcaagccccttctccccagcgagaaaaagtgcctcatggacacctacacgcgcattaacgtgcacccgcacaagattcagtacgtcgagtgccacgccaccggcacgccccagggtgatcgtgtggaaatcgacgccgtcaaggcctgctttgaaggcaaggtcccccgtttcggtaccacaaagggcaactttggacacaccctcgtcgcagccggctttgccggtatgtgcaaggtcctcctctccatgaagcatggcatcatcccgcccaccccgggtatcgatgacgagaccaagatggaccctctcgtcgtctccggtgaggccatcccatggccagagaccaacggcgagcccaagcgcgccggtctctcggcctttggctttggtggcaccaacgcccatgccgtctttgaggagcatgacccctccaacgccgcctgcacgggccacgactccatttctgcgctctcggcccgctgcggcggtgaaagcaacatgcgcatcgccatcactggtatggacgccacctttggcgctctcaagggactcgacgccttcgagcgcgccatttacaccggcgctcacggtgccatcccactcccagaaaagcgctggcgctttctcggcaaggacaaggactttcttgacctctgcggcgtcaaggccaccccgcacggctgctacattgaagatgttgaggtcgacttccagcgcctccgcacgcccatgacccctgaagacatgctcctccctcagcagcttctggccgtcaccaccattgaccgcgccatcctcgactcgggaatgaaaaagggtggcaatgtcgccgtctttgtcggcctcggcaccgacctcgagctctaccgtcaccgtgctcgcgtcgctctcaaggagcgcgtccgccctgaagcctccaagaagctcaatgacatgatgcagtacattaacgactgcggcacatccacatcgtacacctcgtacattggcaacctcgtcgccacgcgcgtctcgtcgcagtggggcttcacgggcccctcctttacgatcaccgagggcaacaactccgtctaccgctgcgccgagctcggcaagtacctcctcgagaccggcgaggtcgatggcgtcgtcgttgcgggtgtcgatctctgcggcagtgccgaaaacctttacgtcaagtctcgccgcttcaaggtgtccacctccgataccccgcgcgccagctttgacgccgccgccgatggctactttgtcggcgagggctgcggtgcctttgtgctcaagcgtgagactagctgcaccaaggacgaccgtatctacgcttgcatggatgccatcgtccctggcaacgtccctagcgcctgcttgcgcgaggccctcgaccaggcgcgcgtcaagccgggcgatatcgagatgctcgagctcagcgccgactccgcccgccacctcaaggacccgtccgtcctgcccaaggagctcactgccgaggaggaaatcggcggccttcagacgatccttcgtgacgatgacaagctcccgcgcaacgtcgcaacgggcagtgtcaaggccaccgtcggtgacaccggttatgcctctggtgctgccagcctcatcaaggctgcgctttgcatctacaaccgctacctgcccagcaacggcgacgactgggatgaacccgcccctgaggcgccctgggacagcaccctctttgcgtgccagacctcgcgcgcttggctcaagaaccctggcgagcgtcgctatgcggccgtctcgggcgtctccgagacgcgctcgtgctattccgtgctcctctccgaagccgagggccactacgagcgcgagaaccgcatctcgctcgacgaggaggcgcccaagctcattgtgcttcgcgccgactcccacgaggagatccttggtcgcctcgacaagatccgcgagcgcttcttgcagcccacgggcgccgccccgcgcgagtccgagctcaaggcgcaggcccgccgcatcttcctcgagctcctcggcgagacccttgcccaggatgccgcttcttcaggctcgcaaaagcccctcgctctcagcctcgtctccacgccctccaagctccagcgcgaggtcgagctcgcggccaagggtatcccgcgctgcctcaagatgcgccgcgattggagctcccctgctggcagccgctacgcgcctgagccgctcgccagcgaccgcgtcgccttcatgtacggcgaaggtcgcagcccttactacggcatcacccaagacattcaccgcatttggcccgaactccacgaggtcatcaacgaaaagacgaaccgtctctgggccgaaggcgaccgctgggtcatgccgcgcgccagcttcaagtcggagctcgagagccagcagcaagagtttgatcgcaacatgattgaaatgttccgtcttggaatcctcacctcaattgccttcaccaatctggcgcgcgacgttctcaacatcacgcccaaggccgcctttggcctcagtcttggcgagatttccatgatttttgccttttccaagaagaacggtctcatctccgaccagctcaccaaggatcttcgcgagtccgacgtgtggaacaaggctctggccgttgaatttaatgcgctgcgcgaggcctggggcattccacagagtgtccccaaggacgagttctggcaaggctacattgtgcgcggcaccaagcaggatatcgaggcggccatcgccccggacagcaagtacgtgcgcctcaccatcatcaatgatgccaacaccgccctcattagcggcaagcccgacgcctgcaaggctgcgatcgcgcgtctcggtggcaacattcctgcgcttcccgtgacccagggcatgtgcggccactgccccgaggtgggaccttataccaaggatatcgccaagatccatgccaaccttgagttccccgttgtcgacggccttgacctctggaccacaatcaaccagaagcgcctcgtgccacgcgccacgggcgccaaggacgaatgggccccttcttcctttggcgagtacgccggccagctctacgagaagcaggctaacttcccccaaatcgtcgagaccatttacaagcaaaactacgacgtctttgtcgaggttgggcccaacaaccaccgtagcaccgcagtgcgcaccacgcttggtccccagcgcaaccaccttgctggcgccatcgacaagcagaacgaggatgcttggacgaccatcgtcaagcttgtggcttcgctcaaggcccaccttgttcctggcgtcacgatctcgccgctgtaccactccaagcttgtggcggaggctgaggcttgctacgctgcgctctgcaagggtgaaaagcccaagaagaacaagtttgtgcgcaagattcagctcaacggtcgcttcaacagcaaggcggaccccatctcctcggccgatcttgccagctttccgcctgcggaccctgccattgaagccgccatctcgagccgcatcatgaagccggttgctccgaagttctacgcgcgtctcaacattgacgagcaggacgagacccgtgatccgatcctcaacaaggacaacgcgccgtcttccagctctagctcctcttccagctcttccagctcttccagcccgtcgccagctccgtccgccccagtgcaaaagaaggctgctccggccgcggagaccaaggctgttgcttcggctgacgcacttcgcagtgccctgctcgatctcgacagtatgcttgcgctgagctctgccagtgcctccggcaaccttgttgagactgcgcctagcgacgcctcggtcattgtgccgccctgcaacattgcggatctcggcagccgcgccttcatgaaaacgtacggtgtttcggcgcctctgtacacgggcgccatggccaagggcattgcctctgcggacctcgtcattgccgccggccgccagggcatccttgcgtcctttggcgccggcggacttcccatgcaggttgtgcgtgagtccatcgaaaagattcaggccgccctgcccaatggcccgtacgctgtcaaccttatccattctccctttgacagcaacctcgaaaagggcaatgtcgatctcttcctcgagaagggtgtcacctttgtcgaggcctcggcctttatgacgctcaccccgcaggtcgtgcggtaccgcgcggctggcctcacgcgcaacgccgacggctcggtcaacatccgcaaccgtatcattggcaaggtctcgcgcaccgagctcgccgagatgttcatgcgtcctgcgcccgagcaccttcttcagaagctcattgcttccggcgagatcaaccaggagcaggccgagctcgcccgccgtgttcccgtcgctgacgacatcgcggtcgaagctgactcgggtggccacaccgacaaccgccccatccacgtcattctgcccctcatcatcaaccttcgcgaccgccttcaccgcgagtgcggctacccggccaaccttcgcgtccgtgtgggcgccggcggtggcattgggtgcccccaggcggcgctggccaccttcaacatgggtgcctcctttattgtcaccggcaccgtgaaccaggtcgccaagcagtcgggcacgtgcgacaatgtgcgcaagcagctcgcgaaggccacttactcggacgtatgcatggccccggctgccgacatgttcgaggaaggcgtcaagcttcaggtcctcaagaagggaaccatgtttccctcgcgcgccaacaagctctacgagctcttttgcaagtacgactcgttcgagtccatgccccccgcagagcttgcgcgcgtcgagaagcgcatcttcagccgcgcgctcgaagaggtctgggacgagaccaaaaacttttacattaaccgtcttcacaacccggagaagatccagcgcgccgagcgcgaccccaagctcaagatgtcgctgtgctttcgctggtacctgagcctggcgagccgctgggccaacactggagcttccgatcgcgtcatggactaccaggtctggtgcggtcctgccattggttccttcaacgatttcatcaagggaacttaccttgatccggccgtcgcaaacgagtacccgtgcgtcgttcagattaacaagcagatccttcgtggagcgtgcttcttgcgccgtctcgaaattctgcgcaacgcacgcctttccgatggcgctgccgctcttgtggccagcatcgatgacacatacgtcccggccgagaagctgtaagcggccgcatttaaatggatccactaggccatggtgacttaaggtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctagctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaacatatggcgctccgtgtcaagacgaacaagaagccatgctgggagatgaccaaggaggagctgaccagcggcaagaccgaggtgttcaactatgaggaactcctcgagttcgcagagggcgacatcgccaaggtcttcggacccgagttcgccgtcatcgacaagtacccgcgccgcgtgcgcctgcccgcccgcgagtacctgctcgtgacccgcgtcaccctcatggacgccgaggtcaacaactaccgcgtcggcgcccgcatggtcaccgagtacgatctccccgtcaacggagagctctccgagggcggagactgcccctgggccgtcctggtcgagagtggccagtgcgatctcatgctcatctcctacatgggcattgacttccagaaccagggcgaccgcgtctaccgcctgctcaacaccacgctcaccttttacggcgtggcccacgagggcgagaccctcgagtacgacattcgcgtcaccggcttcgccaagcgtctcgacggcggcatctccatgttcttcttcgagtacgactgctacgtcaacggccgcctcctcatcgagatgcgcgatggctgcgccggcttcttcaccaacgaggagctcgacgccggcaagggcgtcgtcttcacccgcggcgacctcgccgcccgcgccaagatcccaaagcaggacgtctccccctacgccgtcgccccctgcctccacaagaccaagctcaacgaaaaggagatgcagaccctcgtcgacaaggactgggcatccgtctttggctccaagaacggcatgccggaaatcaactacaaactctgcgcgcgtaagatgctcatgattgaccgcgtcaccagcattgaccacaagggcggtgtctacggcctcggtcagctcgtcggtgaaaagatcctcgagcgcgaccactggtactttccctgccactttgtcaaggatcaggtcatggccggatccctcgtctccgacggctgcagccagatgctcaagatgtacatgatctggctcggcctccacctcaccaccggaccctttgacttccgcccggtcaacggccaccccaacaaggtccgctgccgcggccaaatctccccgcacaagggcaagctcgtctacgtcatggagatcaaggagatgggcttcgacgaggacaacgacccgtacgccattgccgacgtcaacatcattgatgtcgacttcgaaaagggccaggactttagcctcgaccgcatcagcgactacggcaagggcgacctcaacaagaagatcgtcgtcgactttaagggcatcgctctcaagatgcagaagcgctccaccaacaagaacccctccaaggttcagcccgtctttgccaacggcgccgccactgtcggccccgaggcctccaaggcttcctccggcgccagcgccagcgccagcgccgccccggccaagcctgccttcagcgccgatgttcttgcgcccaagcccgttgcccttcccgagcacatcctcaagggcgacgccctcgcccccaaggagatgtcctggcaccccatggcccgcatcccgggcaacccgacgccctcttttgcgccctcggcctacaagccgcgcaacatcgcctttacgcccttccccggcaaccccaacgataacgaccacaccccgggcaagatgccgctcacctggttcaacatggccgagttcatggccggcaaggtcagcatgtgcctcggccccgagttcgccaagttcgacgactcgaacaccagccgcagccccgcttgggacctcgctctcgtcacccgcgccgtgtctgtgtctgacctcaagcacgtcaactaccgcaacatcgacctcgacccctccaagggtaccatggtcggcgagttcgactgccccgcggacgcctggttctacaagggcgcctgcaacgatgcccacatgccgtactcgatcctcatggagatcgccctccagacctcgggtgtgctcacctcggtgctcaaggcgcccctgaccatggagaaggacgacatcctcttccgcaacctcgacgccaacgccgagttcgtgcgcgccgacctcgactaccgcggcaagactatccgcaacgtcaccaagtgcactggctacagcatgctcggcgagatgggcgtccaccgcttcacctttgagctctacgtcgatgatgtgctcttttacaagggctcgacctcgttcggctggttcgtgcccgaggtctttgccgcccaggccggcctcgacaacggccgcaagtcggagccctggttcattgagaacaaggttccggcctcgcaggtctcctcctttgacgtgcgccccaacggcagcggccgcaccgccatcttcgccaacgcccccagcggcgcccagctcaaccgccgcacggaccagggccagtacctcgacgccgtcgacattgtctccggcagcggcaagaagagcctcggctacgcccacggttccaagacggtcaacccgaacgactggttcttctcgtgccacttttggtttgactcggtcatgcccggaagtctcggtgtcgagtccatgttccagctcgtcgaggccatcgccgcccacgaggatctcgctggcaagcacggcattgccaaccccacctttgtgcacgccccgggcaagatcagctggaagtaccgcggccagctcacgcccaagagcaagaagatggactcggaggtccacatcgtgtccgtggacgcccacgacggcgttgtcgacctcgtcgccgacggcttcctctgggccgacagcctccgcgtctactcggtgagcaacattcgcgtgcgcatcgcctccggtgaggcccctgccgccgcctcctccgccgcctctgtgggctcctcggcttcgtccgtcgagcgcacgcgctcgagccccgctgtcgcctccggcccggcccagaccatcgacctcaagcagctcaagaccgagctcctcgagctcgatgccccgctctacctctcgcaggacccgaccagcggccagctcaagaagcacaccgacgtggcctccggccaggccaccatcgtgcagccctgcacgctcggcgacctcggtgaccgctccttcatggagacctacggcgtcgtcgccccgctgtacacgggcgccatggccaagggcattgcctcggcggacctcgtcatcgccgccggcaagcgcaagatcctcggctcctttggcgccggcggcctccccatgcaccacgtgcgcgccgccctcgagaagatccaggccgccctgcctcagggcccctacgccgtcaacctcatccactcgccttttgacagcaacctcgagaagggcaacgtcgatctcttcctcgagaagggcgtcactgtggtggaggcctcggcattcatgaccctcaccccgcaggtcgtgcgctaccgcgccgccggcctctcgcgcaacgccgacggttcggtcaacatccgcaaccgcatcatcggcaaggtctcgcgcaccgagctcgccgagatgttcatccgcccggccccggagcacctcctcgagaagctcatcgcctcgggcgagatcacccaggagcaggccgagctcgcgcgccgcgttcccgtcgccgacgatatcgctgtcgaggctgactcgggcggccacaccgacaaccgccccatccacgtcatcctcccgctcatcatcaacctccgcaaccgcctgcaccgcgagtgcggctaccccgcgcacctccgcgtccgcgttggcgccggcggtggcgtcggctgcccgcaggccgccgccgccgcgctcaccatgggcgccgccttcatcgtcaccggcactgtcaaccaggtcgccaagcagtccggcacctgcgacaacgtgcgcaagcagctctcgcaggccacctactcggatatctgcatggccccggccgccgacatgttcgaggagggcgtcaagctccaggtcctcaagaagggaaccatgttcccctcgcgcgccaacaagctctacgagctcttttgcaagtacgactccttcgactccatgcctcctgccgagctcgagcgcatcgagaagcgtatcttcaagcgcgcactccaggaggtctgggaggagaccaaggacttttacattaacggtctcaagaacccggagaagatccagcgcgccgagcacgaccccaagctcaagatgtcgctctgcttccgctggtaccttggtcttgccagccgctgggccaacatgggcgccccggaccgcgtcatggactaccaggtctggtgtggcccggccattggcgccttcaacgacttcatcaagggcacctacctcgaccccgctgtctccaacgagtacccctgtgtcgtccagatcaacctgcaaatcctccgtggtgcctgctacctgcgccgtctcaacgccctgcgcaacgacccgcgcattgacctcgagaccgaggatgctgcctttgtctacgagcccaccaacgcgctctaagctagcatttaaatctaggccatggtgacttaaggtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaacctaccatggctcccactcccgacgccaccgcgcctctgaacaagccgagcgactatgccgtctaccacgaggaagacggccccttctggaccgccgattccagcggcgtctcgcgcgtgaactttagcgagaccggcgtgggatccgagggcgtcatccctgcgctcacgctcatcgacgtcttcgagagggccgtcaagcgcggcggaaacaggatcgccttccgcacggaaaacatgcccacgctccgccgcggcgaagaggccccggacgcgctgccgctcaaggactggaagtcctggtcctggaaacagtacaaggccgacgtccaccgcatcgccagggctctcatggacctcggcgttgagcagcatgacgccgtctccatttttggctttaactcgcccgaatggtttctcagtgccgtcggcgccgtgcacgcaggtgccaagattgccggcatttacccctcagacacgcccgcccaggtccagtacaaggccttccacagtgacaccgctgttgccgttgtcgaaaacgagcagtgcttcaagaagttcgccgaggtcgtcgaggaccttccttacctcaaggccattgtttgctgggactatgaagccacagacatcacgcgcgaggacggctccgtcgtcgaggtcctcacctttgccgagttcctcaagcgcggcgacaccgtcgaggcggccgcccttgacgagcgcatctccaagatcgagcccaccatgtgcgctgcccttatttacaccagcggtactaccggccgccccaaggccgttatgatttcgcacgacaaccttgttttcgaggccagcgccgtcgtccccaacctcggaggagcctgtacgaccactgctgaggagcgcattctctcgtacctgcctctctcgcacgtcgctggtatgatggttgatattattgcccccatcattgccaccgccttccacaagggccgcatctgcgtctgctttgctcgcccgtacgatttgcgcaccggcacgctgggccagcgcctcaacgccgtggagcccaccatcttccttggcgtgccccgtgtgtgggaaaagattcaggaaaagctcatggccgtcggtgccaaaaccaccggcctcaagaagaagctctctacggccgccaagaagcgtggtcttgaattccaggaggagcagcaaatcggccgctccggtgccaaccctggctttggcccccttggcatctacaagaagctcctcggcctcatcaagggcaagctgggcctcaccaagtgcaagtttgcctttgctggtgccgcgcccatgacccgtgagacccttcagtactttggcgcgctgaacatcaacattaacgaggtctacggcatgtccgagtgctccggtgccgccacctggtccacggacaaggcccacgagtggggcactgttggctacgagatgcccagttgcgaggtccgcgtcttcaagattgccgaggacggtaccaagaccgagtgcccgcgcgccgccgacattatgcatgctaccgaggaggagcagggcgaagtttgcttccgcggccgtaacatcatgatgggctaccttgccaaccccaagcttggcgacgaccacgttgccgagatcgaggagaagaacgctgccgctatcgactccgagggctggctccacagtggtgataagggcgccatttctacccgcggcatgctcaagatcacgggccgctacaaggagctcatcatcggcgccggtggcgagaacgtggcgcccgtccctattgaggacgccatcaaggcgcgcatgccttttgtttccaacgccatgatggtcggagataagcgcaagttcatggctgtcctccttaccctcaagacggttggcgccacgggcgagcttcccggtacgaacaagctcatgggcgctgccgccgactatggtgagaccatcgaggacgcctgcgacaacgaggcgctcattgaggagatcacgcagcagctcaaggagatcggtgatgatggcgatgtcacgccctcgaacgcggctcgcatccaaaagttcaccattctcccgctcgacttttccgtctccacggacgagctcacggccacgctcaagctcaagcgctccgtggtcgcagacaagtacgaagacatcatcgaggccttttacgagtccaagagcgtttttgtgccgtactcgaccgttggcgcctacgccacgggcggcccggtcgacgactccgttgtcgatggctccttcaagggcgactttagcatgattggcgacgatgatccggatcttcaaaacgtcgatgtcctcgaggcgattgacgaggacaattaaatttccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatcactagagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgttgcagcatacttggctaccaaaacccccaaatttaaccttattgtcagatgaagttcatctctggcgcattccccttgaccaaccagaatcacagctacaggatttagccgctaccttatctagtgacgaattagcccgtgcaaacagattttattttcccgaacatcgccggcgttttactgctggtcgtggtattctccgcagtatcttggggggctatttgggtgtggaaccagggcaagttaaatttgattatgaatcccgtggtaaaccaatattaggcgatcgctttgccgagagtggtttattatttaacttgtcacactcccagaacttggccttgtgtgcagtcaattacacgcgccaaatcggcatcgatttagaatatctccgccccacatctgatttagaatcccttgccaaaaggttctttttaccgcgagaatatgaattattgcgatcgctacccgatgagcaaaaacaaaaaattttctttcgttactggacttgtaaagaggcttatcttaaagcaacgggtgacggcatcgctaaattagaggaaattgaaatagcactaactcccacagaaccagctaagttacagacagctccagcgtggagtctcctagagctagtgccagatgataattgtgttgctgctgttgccgtggcgggttttggctggcagccaaaattctggcattattgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcctagtgctagcctcgaggtcgacacccagcttt

SEQ ID NO: 40 - DNA, 35302 bp, Artificial sequence
  plasmid pDAB7368
ttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctagctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcggcccgtctgcaggagcaaaagggaggcgagatggatacccgcattgccatcatcggcatgtcggccatcctcccctgcggcacgaccgtgcgcgagtcgtgggagaccatccgcgccggcatcgactgcctgtcggatctccccgaggaccgcgtcgacgtgacggcgtactttgaccccgtcaagaccaccaaggacaagatctactgcaagcgcggtggcttcattcccgagtacgactttgacgcccgcgagttcggactcaacatgttccagatggaggactcggacgcaaaccagaccatctcgcttctcaaggtcaaggaggccctccaggacgccggcatcgacgccctcggcaaggaaaagaagaacatcggctgcgtgctcggcattggcggcggccaaaagtccagccacgagttctactcgcgccttaattatgttgtcgtggagaaggtcctccgcaagatgggcatgcccgaggaggacgtcaaggtcgccgtcgaaaagtacaaggccaacttccccgagtggcgcctcgactccttccctggcttcctcggcaacgtcaccgccggtcgctgcaccaacaccttcaacctcgacggcatgaactgcgttgtcgacgccgcatgcgcctcgtccctcatcgccgtcaaggtcgccatcgacgagctgctctacggtgactgcgacatgatggtcaccggtgccacctgcacggataactccatcggcatgtacatggccttctccaagacccccgtgttctccacggaccccagcgtgcgcgcctacgacgaaaagacaaagggcatgctcatcggcgagggctccgccatgctcgtcctcaagcgctacgccgacgccgtccgcgacggcgatgagatccacgctgttattcgcggctgcgcctcctccagtgatggcaaggccgccggcatctacacgcccaccatttcgggccaggaggaggccctccgccgcgcctacaaccgcgcctgtgtcgacccggccaccgtcactctcgtcgagggtcacggcaccggtactcccgttggcgaccgcatcgagctcaccgccttgcgcaacctctttgacaaggcctacggcgagggcaacaccgaaaaggtcgctgtgggcagcatcaagtccagcatcggccatctcaaggccgtcgccggtctcgccggtatgatcaaggtcatcatggcgctcaagcacaagactctcccgggcaccatcaacgtcgacaacccacccaacctctacgacaacacgcccatcaacgagtcctcgctctacattaacaccatgaaccgcccctggttcccgccccctggtgtgccccgccgcgccggcatttcgagctttggctttggtggcgccaactaccacgccgtcctcgaggaggccgagcccgagcacacgaccgcgtaccgcctcaacaagcgcccgcagcccgtgctcatgatggccgccacgcccgcggccctccagtcgctctgcgaggcccagctcaaggagttcgaggccgccatcaaggagaacgagaccgtcaagaacaccgcctacatcaagtgcgtcaagttcggcgagcagttcaaattccctggctccatcccggccacaaacgcgcgcctcggcttcctcgtcaaggatgctgaggatgcctgctccaccctccgtgccatctgcgcccaattcgccaaggatgtcaccaaggaggcctggcgcctcccccgcgagggcgtcagcttccgcgccaagggcatcgccaccaacggcgctgtcgccgcgctcttctccggccagggcgcgcagtacacgcacatgtttagcgaggtggccatgaactggccccagttccgccagagcattgccgccatggacgccgcccagtccaaggtcgctggaagcgacaaggactttgagcgcgtctcccaggtcctctacccgcgcaagccgtacgagcgtgagcccgagcaggaccacaagaagatctccctcaccgcctactcgcagccctcgaccctggcctgcgctctcggtgcctttgagatcttcaaggaggccggcttcaccccggactttgccgccggccattcgctcggtgagttcgccgccctctacgccgcgggctgcgtcgaccgcgacgagctctttgagcttgtctgccgccgcgcccgcatcatgggcggcaaggacgcaccggccacccccaagggctgcatggccgccgtcattggccccaacgccgagaacatcaaggtccaggccgccaacgtctggctcggcaactccaactcgccttcgcagaccgtcatcaccggctccgtcgaaggtatccaggccgagagcgcccgcctccagaaggagggcttccgcgtcgtgcctcttgcctgcgagagcgccttccactcgccccagatggagaacgcctcgtcggccttcaaggacgtcatctccaaggtctccttccgcacccccaaggccgagaccaagctcttcagcaacgtctctggcgagacctaccccacggacgcccgcgagatgcttacgcagcacatgaccagcagcgtcaagttcctcacccaggtccgcaacatgcaccaggccggtgcgcgcatctttgtcgagttcggacccaagcaggtgctctccaagcttgtctccgagaccctcaaggatgacccctcggttgtcaccgtctctgtcaacccggcctcgggcacggattcggacatccagctccgcgacgcggccgtccagctcgttgtcgctggcgtcaaccttcagggctttgacaagtgggacgcccccgatgccacccgcatgcaggccatcaagaagaagcgcactaccctccgcctttcggccgccacctacgtctcggacaagaccaagaaggtccgcgacgccgccatgaacgatggccgctgcgtcacctacctcaagggcgccgcaccgctcatcaaggccccggagcccgttgtcgacgaggccgccaagcgcgaggccgagcgtctccagaaggagcttcaggatgcccagcgccagctcgacgacgccaagcgcgccgccgccgaggccaactccaagctcgccgctgccaaggaggaggccaagaccgccgctgcttcggccaagcccgcagttgacactgctgttgtcgaaaagcatcgtgccatcctcaagtccatgctcgcggagctcgatggctacggatcggtcgacgcttcttccctccagcagcagcagcagcagcagacggcccccgccccggtcaaggctgctgcgcctgccgcccccgttgcctcggcccctgccccggctgtctcgaacgagcttcttgagaaggccgagactgtcgtcatggaggtcctcgccgccaagaccggctacgagaccgacatgatcgaggctgacatggagctcgagaccgagctcggcattgactccatcaagcgtgtcgagatcctctccgaggtccaggccatgctcaatgtcgaggccaaggatgtcgatgccctcagccgcactcgcactgttggtgaggttgtcaacgccatgaaggccgagatcgctggcagctctgccccggcgcctgctgccgctgctccggctccggccaaggctgcccctgccgccgctgcgcctgctgtctcgaacgagcttctcgagaaggccgagaccgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgacgctctcagccgcactcgcactgtgggtgaggtcgtcaacgccatgaaggctgagatcgctggtggctctgccccggcgcctgccgccgctgccccaggtccggctgctgccgcccctgcgcctgccgccgccgcccctgctgtctcgaacgagcttcttgagaaggccgagaccgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgctgtctcgagcgagcttctcgagaaggccgagactgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgccgcccctgcgcctgctgtctcgagcgagcttctcgagaaggccgagactgtcgtcatggaggtcctcgccgccaagactggctacgagactgacatgattgagtccgacatggagctcgagaccgagctcggcattgactccatcaagcgtgtcgagattctctccgaggttcaggccatgctcaacgtcgaggccaaggacgtcgacgctctcagccgcactcgcactgttggtgaggtcgtcgatgccatgaaggctgagatcgctggcagctccgcctcggcgcctgccgccgctgctcctgctccggctgctgccgctcctgcgcccgctgccgccgcccctgctgtctcgaacgagcttctcgagaaagccgagactgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttctcgagaaggccgagactgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgatgctctcagccgcactcgcactgttggcgaggtcgtcgatgccatgaaggctgagatcgccggcagctccgccccggcgcctgccgccgctgctcctgctccggctgctgccgctcctgcgcccgctgccgctgcccctgctgtctcgagcgagcttctcgagaaggccgagaccgtcgtcatggaggtcctcgccgccaagactggctacgagactgacatgattgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttcttgagaaggccgagaccgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgacgctctcagccgcactcgcactgttggcgaggtcgtcgatgccatgaaggctgagatcgctggtggctctgccccggcgcctgccgccgctgctcctgcctcggctggcgccgcgcctgcggtcaagattgactcggtccacggcgctgactgtgatgatctttccctgatgcacgccaaggtggttgacatccgccgcccggacgagctcatcctggagcgccccgagaaccgccccgttctcgttgtcgatgacggcagcgagctcaccctcgccctggtccgcgtcctcggcgcctgcgccgttgtcctgacctttgagggtctccagctcgctcagcgcgctggtgccgctgccatccgccacgtgctcgccaaggatctttccgcggagagcgccgagaaggccatcaaggaggccgagcagcgctttggcgctctcggcggcttcatctcgcagcaggcggagcgcttcgagcccgccgaaatcctcggcttcacgctcatgtgcgccaagttcgccaaggcttccctctgcacggctgtggctggcggccgcccggcctttatcggtgtggcgcgccttgacggccgcctcggattcacttcgcagggcacttctgacgcgctcaagcgtgcccagcgtggtgccatctttggcctctgcaagaccatcggcctcgagtggtccgagtctgacgtcttttcccgcggcgtggacattgctcagggcatgcaccccgaggatgccgccgtggcgattgtgcgcgagatggcgtgcgctgacattcgcattcgcgaggtcggcattggcgcaaaccagcagcgctgcacgatccgtgccgccaagctcgagaccggcaacccgcagcgccagatcgccaaggacgacgtgctgctcgtttctggcggcgctcgcggcatcacgcctctttgcatccgggagatcacgcgccagatcgcgggcggcaagtacattctgcttggccgcagcaaggtctctgcgagcgaaccggcatggtgcgctggcatcactgacgagaaggctgtgcaaaaggctgctacccaggagctcaagcgcgcctttagcgctggcgagggccccaagcccacgccccgcgctgtcactaagcttgtgggctctgttcttggcgctcgcgaggtgcgcagctctattgctgcgattgaagcgctcggcggcaaggccatctactcgtcgtgcgacgtgaactctgccgccgacgtggccaaggccgtgcgcgatgccgagtcccagctcggtgcccgcgtctcgggcatcgttcatgcctcgggcgtgctccgcgaccgtctcatcgagaagaagctccccgacgagttcgacgccgtctttggcaccaaggtcaccggtctcgagaacctcctcgccgccgtcgaccgcgccaacctcaagcacatggtcctcttcagctcgctcgccggcttccacggcaacgtcggccagtctgactacgccatggccaacgaggcccttaacaagatgggcctcgagctcgccaaggacgtctcggtcaagtcgatctgcttcggtccctgggacggtggcatggtgacgccgcagctcaagaagcagttccaggagatgggcgtgcagatcatcccccgcgagggcggcgctgataccgtggcgcgcatcgtgctcggctcctcgccggctgagatccttgtcggcaactggcgcaccccgtccaagaaggtcggctcggacaccatcaccctgcaccgcaagatttccgccaagtccaaccccttcctcgaggaccacgtcatccagggccgccgcgtgctgcccatgacgctggccattggctcgctcgcggagacctgcctcggcctcttccccggctactcgctctgggccattgacgacgcccagctcttcaagggtgtcactgtcgacggcgacgtcaactgcgaggtgaccctcaccccgtcgacggcgccctcgggccgcgtcaacgtccaggccacgctcaagaccttttccagcggcaagctggtcccggcctaccgcgccgtcatcgtgctctccaaccagggcgcgcccccggccaacgccaccatgcagccgccctcgctcgatgccgatccggcgctccagggctccgtctacgacggcaagaccctcttccacggcccggccttccgcggcatcgatgacgtgctctcgtgcaccaagagccagcttgtggccaagtgcagcgctgtccccggctccgacgccgctcgcggcgagtttgccacggacactgacgcccatgaccccttcgtgaacgacctggcctttcaggccatgctcgtctgggtgcgccgcacgctcggccaggctgcgctccccaactcgatccagcgcatcgtccagcaccgcccggtcccgcaggacaagcccttctacattaccctccgctccaaccagtcgggcggtcactcccagcacaagcacgcccttcagttccacaacgagcagggcgatctcttcattgatgtccaggcttcggtcatcgccacggacagccttgccttctaaatctaaactaggccatggtgacttaaggtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctagctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggccgctcgcaacgtgtctgcagcgcatgagatgcacgatgaaaagcgcatcgccgtcgtcggcatggccgtccagtacgccggatgcaaaaccaaggacgagttctgggaggtgctcatgaacggcaaggtcgagtccaaggtgatcagcgacaaacgactcggctccaactaccgcgccgagcactacaaagcagagcgcagcaagtatgccgacaccttttgcaacgaaacgtacggcacccttgacgagaacgagatcgacaacgagcacgaactcctcctcaacctcgccaagcaggcactcgcagagacatccgtcaaagactcgacacgctgcggcatcgtcagcggctgcctctcgttccccatggacaacctccagggtgaactcctcaacgtgtaccaaaaccatgtcgagaaaaagctcggggcccgcgtcttcaaggacgcctcccattggtccgaacgcgagcagtccaacaaacccgaggccggtgaccgccgcatcttcatggacccggcctccttcgtcgccgaagaactcaacctcggcgcccttcactactccgtcgacgcagcatgcgccacggcgctctacgtgctccgcctcgcgcaggatcatctcgtctccggcgccgccgacgtcatgctctgcggtgccacctgcctgccggagccctttttcatcctttcgggcttttccaccttccaggccatgcccgtcggcacgggccagaacgtgtccatgccgctgcacaaggacagccagggcctcaccccgggtgagggcggctccatcatggtcctcaagcgtctcgatgatgccatccgcgacggcgaccacatctacggcacccttctcggcgccaatgtcagcaactccggcacaggtctgcccctcaagccccttctccccagcgagaaaaagtgcctcatggacacctacacgcgcattaacgtgcacccgcacaagattcagtacgtcgagtgccacgccaccggcacgccccagggtgatcgtgtggaaatcgacgccgtcaaggcctgctttgaaggcaaggtcccccgtttcggtaccacaaagggcaactttggacacaccctcgtcgcagccggctttgccggtatgtgcaaggtcctcctctccatgaagcatggcatcatcccgcccaccccgggtatcgatgacgagaccaagatggaccctctcgtcgtctccggtgaggccatcccatggccagagaccaacggcgagcccaagcgcgccggtctctcggcctttggctttggtggcaccaacgcccatgccgtctttgaggagcatgacccctccaacgccgcctgcacgggccacgactccatttctgcgctctcggcccgctgcggcggtgaaagcaacatgcgcatcgccatcactggtatggacgccacctttggcgctctcaagggactcgacgccttcgagcgcgccatttacaccggcgctcacggtgccatcccactcccagaaaagcgctggcgctttctcggcaaggacaaggactttcttgacctctgcggcgtcaaggccaccccgcacggctgctacattgaagatgttgaggtcgacttccagcgcctccgcacgcccatgacccctgaagacatgctcctccctcagcagcttctggccgtcaccaccattgaccgcgccatcctcgactcgggaatgaaaaagggtggcaatgtcgccgtctttgtcggcctcggcaccgacctcgagctctaccgtcaccgtgctcgcgtcgctctcaaggagcgcgtccgccctgaagcctccaagaagctcaatgacatgatgcagtacattaacgactgcggcacatccacatcgtacacctcgtacattggcaacctcgtcgccacgcgcgtctcgtcgcagtggggcttcacgggcccctcctttacgatcaccgagggcaacaactccgtctaccgctgcgccgagctcggcaagtacctcctcgagaccggcgaggtcgatggcgtcgtcgttgcgggtgtcgatctctgcggcagtgccgaaaacctttacgtcaagtctcgccgcttcaaggtgtccacctccgataccccgcgcgccagctttgacgccgccgccgatggctactttgtcggcgagggctgcggtgcctttgtgctcaagcgtgagactagctgcaccaaggacgaccgtatctacgcttgcatggatgccatcgtccctggcaacgtccctagcgcctgcttgcgcgaggccctcgaccaggcgcgcgtcaagccgggcgatatcgagatgctcgagctcagcgccgactccgcccgccacctcaaggacccgtccgtcctgcccaaggagctcactgccgaggaggaaatcggcggccttcagacgatccttcgtgacgatgacaagctcccgcgcaacgtcgcaacgggcagtgtcaaggccaccgtcggtgacaccggttatgcctctggtgctgccagcctcatcaaggctgcgctttgcatctacaaccgctacctgcccagcaacggcgacgactgggatgaacccgcccctgaggcgccctgggacagcaccctctttgcgtgccagacctcgcgcgcttggctcaagaaccctggcgagcgtcgctatgcggccgtctcgggcgtctccgagacgcgctcgtgctattccgtgctcctctccgaagccgagggccactacgagcgcgagaaccgcatctcgctcgacgaggaggcgcccaagctcattgtgcttcgcgccgactcccacgaggagatccttggtcgcctcgacaagatccgcgagcgcttcttgcagcccacgggcgccgccccgcgcgagtccgagctcaaggcgcaggcccgccgcatcttcctcgagctcctcggcgagacccttgcccaggatgccgcttcttcaggctcgcaaaagcccctcgctctcagcctcgtctccacgccctccaagctccagcgcgaggtcgagctcgcggccaagggtatcccgcgctgcctcaagatgcgccgcgattggagctcccctgctggcagccgctacgcgcctgagccgctcgccagcgaccgcgtcgccttcatgtacggcgaaggtcgcagcccttactacggcatcacccaagacattcaccgcatttggcccgaactccacgaggtcatcaacgaaaagacgaaccgtctctgggccgaaggcgaccgctgggtcatgccgcgcgccagcttcaagtcggagctcgagagccagcagcaagagtttgatcgcaacatgattgaaatgttccgtcttggaatcctcacctcaattgccttcaccaatctggcgcgcgacgttctcaacatcacgcccaaggccgcctttggcctcagtcttggcgagatttccatgatttttgccttttccaagaagaacggtctcatctccgaccagctcaccaaggatcttcgcgagtccgacgtgtggaacaaggctctggccgttgaatttaatgcgctgcgcgaggcctggggcattccacagagtgtccccaaggacgagttctggcaaggctacattgtgcgcggcaccaagcaggatatcgaggcggccatcgccccggacagcaagtacgtgcgcctcaccatcatcaatgatgccaacaccgccctcattagcggcaagcccgacgcctgcaaggctgcgatcgcgcgtctcggtggcaacattcctgcgcttcccgtgacccagggcatgtgcggccactgccccgaggtgggaccttataccaaggatatcgccaagatccatgccaaccttgagttccccgttgtcgacggccttgacctctggaccacaatcaaccagaagcgcctcgtgccacgcgccacgggcgccaaggacgaatgggccccttcttcctttggcgagtacgccggccagctctacgagaagcaggctaacttcccccaaatcgtcgagaccatttacaagcaaaactacgacgtctttgtcgaggttgggcccaacaaccaccgtagcaccgcagtgcgcaccacgcttggtccccagcgcaaccaccttgctggcgccatcgacaagcagaacgaggatgcttggacgaccatcgtcaagcttgtggcttcgctcaaggcccaccttgttcctggcgtcacgatctcgccgctgtaccactccaagcttgtggcggaggctgaggcttgctacgctgcgctctgcaagggtgaaaagcccaagaagaacaagtttgtgcgcaagattcagctcaacggtcgcttcaacagcaaggcggaccccatctcctcggccgatcttgccagctttccgcctgcggaccctgccattgaagccgccatctcgagccgcatcatgaagccggttgctccgaagttctacgcgcgtctcaacattgacgagcaggacgagacccgtgatccgatcctcaacaaggacaacgcgccgtcttccagctctagctcctcttccagctcttccagctcttccagcccgtcgccagctccgtccgccccagtgcaaaagaaggctgctccggccgcggagaccaaggctgttgcttcggctgacgcacttcgcagtgccctgctcgatctcgacagtatgcttgcgctgagctctgccagtgcctccggcaaccttgttgagactgcgcctagcgacgcctcggtcattgtgccgccctgcaacattgcggatctcggcagccgcgccttcatgaaaacgtacggtgtttcggcgcctctgtacacgggcgccatggccaagggcattgcctctgcggacctcgtcattgccgccggccgccagggcatccttgcgtcctttggcgccggcggacttcccatgcaggttgtgcgtgagtccatcgaaaagattcaggccgccctgcccaatggcccgtacgctgtcaaccttatccattctccctttgacagcaacctcgaaaagggcaatgtcgatctcttcctcgagaagggtgtcacctttgtcgaggcctcggcctttatgacgctcaccccgcaggtcgtgcggtaccgcgcggctggcctcacgcgcaacgccgacggctcggtcaacatccgcaaccgtatcattggcaaggtctcgcgcaccgagctcgccgagatgttcatgcgtcctgcgcccgagcaccttcttcagaagctcattgcttccggcgagatcaaccaggagcaggccgagctcgcccgccgtgttcccgtcgctgacgacatcgcggtcgaagctgactcgggtggccacaccgacaaccgccccatccacgtcattctgcccctcatcatcaaccttcgcgaccgccttcaccgcgagtgcggctacccggccaaccttcgcgtccgtgtgggcgccggcggtggcattgggtgcccccaggcggcgctggccaccttcaacatgggtgcctcctttattgtcaccggcaccgtgaaccaggtcgccaagcagtcgggcacgtgcgacaatgtgcgcaagcagctcgcgaaggccacttactcggacgtatgcatggccccggctgccgacatgttcgaggaaggcgtcaagcttcaggtcctcaagaagggaaccatgtttccctcgcgcgccaacaagctctacgagctcttttgcaagtacgactcgttcgagtccatgccccccgcagagcttgcgcgcgtcgagaagcgcatcttcagccgcgcgctcgaagaggtctgggacgagaccaaaaacttttacattaaccgtcttcacaacccggagaagatccagcgcgccgagcgcgaccccaagctcaagatgtcgctgtgctttcgctggtacctgagcctggcgagccgctgggccaacactggagcttccgatcgcgtcatggactaccaggtctggtgcggtcctgccattggttccttcaacgatttcatcaagggaacttaccttgatccggccgtcgcaaacgagtacccgtgcgtcgttcagattaacaagcagatccttcgtggagcgtgcttcttgcgccgtctcgaaattctgcgcaacgcacgcctttccgatggcgctgccgctcttgtggccagcatcgatgacacatacgtcccggccgagaagctgtaagcggccgcatttaaatggatccactaggccatggtgacttaaggtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctagctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaacatatggcgctccgtgtcaagacgaacaagaagccatgctgggagatgaccaaggaggagctgaccagcggcaagaccgaggtgttcaactatgaggaactcctcgagttcgcagagggcgacatcgccaaggtcttcggacccgagttcgccgtcatcgacaagtacccgcgccgcgtgcgcctgcccgcccgcgagtacctgctcgtgacccgcgtcaccctcatggacgccgaggtcaacaactaccgcgtcggcgcccgcatggtcaccgagtacgatctccccgtcaacggagagctctccgagggcggagactgcccctgggccgtcctggtcgagagtggccagtgcgatctcatgctcatctcctacatgggcattgacttccagaaccagggcgaccgcgtctaccgcctgctcaacaccacgctcaccttttacggcgtggcccacgagggcgagaccctcgagtacgacattcgcgtcaccggcttcgccaagcgtctcgacggcggcatctccatgttcttcttcgagtacgactgctacgtcaacggccgcctcctcatcgagatgcgcgatggctgcgccggcttcttcaccaacgaggagctcgacgccggcaagggcgtcgtcttcacccgcggcgacctcgccgcccgcgccaagatcccaaagcaggacgtctccccctacgccgtcgccccctgcctccacaagaccaagctcaacgaaaaggagatgcagaccctcgtcgacaaggactgggcatccgtctttggctccaagaacggcatgccggaaatcaactacaaactctgcgcgcgtaagatgctcatgattgaccgcgtcaccagcattgaccacaagggcggtgtctacggcctcggtcagctcgtcggtgaaaagatcctcgagcgcgaccactggtactttccctgccactttgtcaaggatcaggtcatggccggatccctcgtctccgacggctgcagccagatgctcaagatgtacatgatctggctcggcctccacctcaccaccggaccctttgacttccgcccggtcaacggccaccccaacaaggtccgctgccgcggccaaatctccccgcacaagggcaagctcgtctacgtcatggagatcaaggagatgggcttcgacgaggacaacgacccgtacgccattgccgacgtcaacatcattgatgtcgacttcgaaaagggccaggactttagcctcgaccgcatcagcgactacggcaagggcgacctcaacaagaagatcgtcgtcgactttaagggcatcgctctcaagatgcagaagcgctccaccaacaagaacccctccaaggttcagcccgtctttgccaacggcgccgccactgtcggccccgaggcctccaaggcttcctccggcgccagcgccagcgccagcgccgccccggccaagcctgccttcagcgccgatgttcttgcgcccaagcccgttgcccttcccgagcacatcctcaagggcgacgccctcgcccccaaggagatgtcctggcaccccatggcccgcatcccgggcaacccgacgccctcttttgcgccctcggcctacaagccgcgcaacatcgcctttacgcccttccccggcaaccccaacgataacgaccacaccccgggcaagatgccgctcacctggttcaacatggccgagttcatggccggcaaggtcagcatgtgcctcggccccgagttcgccaagttcgacgactcgaacaccagccgcagccccgcttgggacctcgctctcgtcacccgcgccgtgtctgtgtctgacctcaagcacgtcaactaccgcaacatcgacctcgacccctccaagggtaccatggtcggcgagttcgactgccccgcggacgcctggttctacaagggcgcctgcaacgatgcccacatgccgtactcgatcctcatggagatcgccctccagacctcgggtgtgctcacctcggtgctcaaggcgcccctgaccatggagaaggacgacatcctcttccgcaacctcgacgccaacgccgagttcgtgcgcgccgacctcgactaccgcggcaagactatccgcaacgtcaccaagtgcactggctacagcatgctcggcgagatgggcgtccaccgcttcacctttgagctctacgtcgatgatgtgctcttttacaagggctcgacctcgttcggctggttcgtgcccgaggtctttgccgcccaggccggcctcgacaacggccgcaagtcggagccctggttcattgagaacaaggttccggcctcgcaggtctcctcctttgacgtgcgccccaacggcagcggccgcaccgccatcttcgccaacgcccccagcggcgcccagctcaaccgccgcacggaccagggccagtacctcgacgccgtcgacattgtctccggcagcggcaagaagagcctcggctacgcccacggttccaagacggtcaacccgaacgactggttcttctcgtgccacttttggtttgactcggtcatgcccggaagtctcggtgtcgagtccatgttccagctcgtcgaggccatcgccgcccacgaggatctcgctggcaagcacggcattgccaaccccacctttgtgcacgccccgggcaagatcagctggaagtaccgcggccagctcacgcccaagagcaagaagatggactcggaggtccacatcgtgtccgtggacgcccacgacggcgttgtcgacctcgtcgccgacggcttcctctgggccgacagcctccgcgtctactcggtgagcaacattcgcgtgcgcatcgcctccggtgaggcccctgccgccgcctcctccgccgcctctgtgggctcctcggcttcgtccgtcgagcgcacgcgctcgagccccgctgtcgcctccggcccggcccagaccatcgacctcaagcagctcaagaccgagctcctcgagctcgatgccccgctctacctctcgcaggacccgaccagcggccagctcaagaagcacaccgacgtggcctccggccaggccaccatcgtgcagccctgcacgctcggcgacctcggtgaccgctccttcatggagacctacggcgtcgtcgccccgctgtacacgggcgccatggccaagggcattgcctcggcggacctcgtcatcgccgccggcaagcgcaagatcctcggctcctttggcgccggcggcctccccatgcaccacgtgcgcgccgccctcgagaagatccaggccgccctgcctcagggcccctacgccgtcaacctcatccactcgccttttgacagcaacctcgagaagggcaacgtcgatctcttcctcgagaagggcgtcactgtggtggaggcctcggcattcatgaccctcaccccgcaggtcgtgcgctaccgcgccgccggcctctcgcgcaacgccgacggttcggtcaacatccgcaaccgcatcatcggcaaggtctcgcgcaccgagctcgccgagatgttcatccgcccggccccggagcacctcctcgagaagctcatcgcctcgggcgagatcacccaggagcaggccgagctcgcgcgccgcgttcccgtcgccgacgatatcgctgtcgaggctgactcgggcggccacaccgacaaccgccccatccacgtcatcctcccgctcatcatcaacctccgcaaccgcctgcaccgcgagtgcggctaccccgcgcacctccgcgtccgcgttggcgccggcggtggcgtcggctgcccgcaggccgccgccgccgcgctcaccatgggcgccgccttcatcgtcaccggcactgtcaaccaggtcgccaagcagtccggcacctgcgacaacgtgcgcaagcagctctcgcaggccacctactcggatatctgcatggccccggccgccgacatgttcgaggagggcgtcaagctccaggtcctcaagaagggaaccatgttcccctcgcgcgccaacaagctctacgagctcttttgcaagtacgactccttcgactccatgcctcctgccgagctcgagcgcatcgagaagcgtatcttcaagcgcgcactccaggaggtctgggaggagaccaaggacttttacattaacggtctcaagaacccggagaagatccagcgcgccgagcacgaccccaagctcaagatgtcgctctgcttccgctggtaccttggtcttgccagccgctgggccaacatgggcgccccggaccgcgtcatggactaccaggtctggtgtggcccggccattggcgccttcaacgacttcatcaagggcacctacctcgaccccgctgtctccaacgagtacccctgtgtcgtccagatcaacctgcaaatcctccgtggtgcctgctacctgcgccgtctcaacgccctgcgcaacgacccgcgcattgacctcgagaccgaggatgctgcctttgtctacgagcccaccaacgcgctctaagctagcatttaaatctaggccatggtgacttaaggtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgttgcagcatacttggctaccaaaacccccaaatttaaccttattgtcagatgaagttcatctctggcgcattccccttgaccaaccagaatcacagctacaggatttagccgctaccttatctagtgacgaattagcccgtgcaaacagattttattttcccgaacatcgccggcgttttactgctggtcgtggtattctccgcagtatcttggggggctatttgggtgtggaaccagggcaagttaaatttgattatgaatcccgtggtaaaccaatattaggcgatcgctttgccgagagtggtttattatttaacttgtcacactcccagaacttggccttgtgtgcagtcaattacacgcgccaaatcggcatcgatttagaatatctccgccccacatctgatttagaatcccttgccaaaaggttctttttaccgcgagaatatgaattattgcgatcgctacccgatgagcaaaaacaaaaaattttctttcgttactggacttgtaaagaggcttatcttaaagcaacgggtgacggcatcgctaaattagaggaaattgaaatagcactaactcccacagaaccagctaagttacagacagctccagcgtggagtctcctagagctagtgccagatgataattgtgttgctgctgttgccgtggcgggttttggctggcagccaaaattctggcattattgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttc

SEQ ID NO: 41 - DNA, 35154 bp, Artificial sequence
  plasmid pDAB7369
ttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttc

SEQ ID NO: 42 - DNA, 36102 bp, Artificial sequence
  plasmid pDAB7370
ttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaacttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttc

SEQ ID NO: 43 - DNA, 39183 bp, Artificial sequence
  plasmid pDAB100518
ttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttaagctctcttgtaacgttaccaatcatcttcacacattctcattctttagcgattctagtctgttcatccctgtcaacagaaggactcttgctgtgtctatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttaagctctcttgtaacgttaccaatcatcttcacacattctcattctttagcgattctagtctgttcatccctgtcaacagaaggactcttgctgtgtctatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttaagctctcttgtaacgttaccaatcatcttcacacattctcattctttagcgattctagtctgttcatccctgtcaacagaaggactcttgctgtgtctatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatcactagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttaagctctcttgtaacgttaccaatcatcttcacacattctcattctttagcgattctagtctgttcatccctgtcaacagaaggactcttgctgtgtctatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttc

SEQ ID NO: 44 - DNA, 38742 bp, Artificial sequence
  plasmid pDAB101476
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaacctaccatggctcccactcccgacgccaccgcgcctctgaacaagccgagcgactatgccgtctaccacgaggaagacggccccttctggaccgccgattccagcggcgtctcgcgcgtgaactttagcgagaccggcgtgggatccgagggcgtcatccctgcgctcacgctcatcgacgtcttcgagagggccgtcaagcgcggcggaaacaggatcgccttccgcacggaaaacatgcccacgctccgccgcggcgaagaggccccggacgcgctgccgctcaaggactggaagtcctggtcctggaaacagtacaaggccgacgtccaccgcatcgccagggctctcatggacctcggcgttgagcagcatgacgccgtctccatttttggctttaactcgcccgaatggtttctcagtgccgtcggcgccgtgcacgcaggtgccaagattgccggcatttacccctcagacacgcccgcccaggtccagtacaaggccttccacagtgacaccgctgttgccgttgtcgaaaacgagcagtgcttcaagaagttcgccgaggtcgtcgaggaccttccttacctcaaggccattgtttgctgggactatgaagccacagacatcacgcgcgaggacggctccgtcgtcgaggtcctcacctttgccgagttcctcaagcgcggcgacaccgtcgaggcggccgcccttgacgagcgcatctccaagatcgagcccaccatgtgcgctgcccttatttacaccagcggtactaccggccgccccaaggccgttatgatttcgcacgacaaccttgttttcgaggccagcgccgtcgtccccaacctcggaggagcctgtacgaccactgctgaggagcgcattctctcgtacctgcctctctcgcacgtcgctggtatgatggttgatattattgcccccatcattgccaccgccttccacaagggccgcatctgcgtctgctttgctcgcccgtacgatttgcgcaccggcacgctgggccagcgcctcaacgccgtggagcccaccatcttccttggcgtgccccgtgtgtgggaaaagattcaggaaaagctcatggccgtcggtgccaaaaccaccggcctcaagaagaagctctctacggccgccaagaagcgtggtcttgaattccaggaggagcagcaaatcggccgctccggtgccaaccctggctttggcccccttggcatctacaagaagctcctcggcctcatcaagggcaagctgggcctcaccaagtgcaagtttgcctttgctggtgccgcgcccatgacccgtgagacccttcagtactttggcgcgctgaacatcaacattaacgaggtctacggcatgtccgagtgctccggtgccgccacctggtccacggacaaggcccacgagtggggcactgttggctacgagatgcccagttgcgaggtccgcgtcttcaagattgccgaggacggtaccaagaccgagtgcccgcgcgccgccgacattatgcatgctaccgaggaggagcagggcgaagtttgcttccgcggccgtaacatcatgatgggctaccttgccaaccccaagcttggcgacgaccacgttgccgagatcgaggagaagaacgctgccgctatcgactccgagggctggctccacagtggtgataagggcgccatttctacccgcggcatgctcaagatcacgggccgctacaaggagctcatcatcggcgccggtggcgagaacgtggcgcccgtccctattgaggacgccatcaaggcgcgcatgccttttgtttccaacgccatgatggtcggagataagcgcaagttcatggctgtcctccttaccctcaagacggttggcgccacgggcgagcttcccggtacgaacaagctcatgggcgctgccgccgactatggtgagaccatcgaggacgcctgcgacaacgaggcgctcattgaggagatcacgcagcagctcaaggagatcggtgatgatggcgatgtcacgccctcgaacgcggctcgcatccaaaagttcaccattctcccgctcgacttttccgtctccacggacgagctcacggccacgctcaagctcaagcgctccgtggtcgcagacaagtacgaagacatcatcgaggccttttacgagtccaagagcgtttttgtgccgtactcgaccgttggcgcctacgccacgggcggcccggtcgacgactccgttgtcgatggctccttcaagggcgactttagcatgattggcgacgatgatccggatcttcaaaacgtcgatgtcctcgaggcgattgacgaggacaattaaatttccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatccctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 45 - DNA, 38760 bp, Artificial sequence
  plasmid pDAB101477
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctcccactcccgacgccaccgcgcctctgaacaagccgagcgactatgccgtctaccacgaggaagacggccccttctggaccgccgattccagcggcgtctcgcgcgtgaactttagcgagaccggcgtgggatccgagggcgtcatccctgcgctcacgctcatcgacgtcttcgagagggccgtcaagcgcggcggaaacaggatcgccttccgcacggaaaacatgcccacgctccgccgcggcgaagaggccccggacgcgctgccgctcaaggactggaagtcctggtcctggaaacagtacaaggccgacgtccaccgcatcgccagggctctcatggacctcggcgttgagcagcacgacgccgtctcgatttttggctttaactcgcccgaatggtttctcagtgccgtcggcgccgtgcacgcaggtgccaagattgccggtatttacccctcagacacgcccgcccaggtccagtacaaggccttccacagtgacaccgctgttgccgttgtcgaaaacgagcagtgcttcaagaagttcgccgaggtcgtcgaggaccttccttacctcaaggccattgtttgctgggactatgaagccacagacatcacgcgcgaggacggctccgtcgtcgaggtcctcacctttgccgagttcctcaagcgcggcgacaccgtcgaggcggccgcccttgacgagcgcatctccaagatcgagcccaccatgtgcgctgcccttatttacaccagcggtactaccggccgccccaaggccgttatgatttcgcacgacaaccttgttttcgaggccagcgccgtcgtccccaacctcggaggagcctgtacgaccactgctgaggagcgcattctctcgtacctgcctctctcgcacgtcgctggtatgatggttgatattattgcccccatcattgccaccgccttccacaagggccgcatctgcgtctgctttgctcgcccgtacgatttgcgcaccggcacgctgggccagcgcctcaacgccgtggagcccaccatcttccttggcgtgccccgtgtgtgggaaaagattcaggaaaagctcatggccgtcggtgccaaaaccaccggcctcaagaagaagctctctacggccgccaagaagcgtggtcttgaattccaggaggagcagcaaatcggccgctccggtgccaaccctggctttggcccccttggcatctacaagaagctcctcggcctcatcaagggcaagctgggcctcaccaagtgcaagtttgcctttgctggtgccgcgcccatgacccgtgagacccttcagtactttggcgcgctgaacatcaacattaacgaggtctacggcatgtcagagtgctccggtgccgccacctggtccacggacaaggcccacgagtggggcactgttggctacgagatgcccagttgcgaggtccgcgtcttcaagattgccgaggacggtaccaagaccgagtgcccgcgcgccgccgacattatgcatgctaccgaggaggagcagggcgaagtttgcttccgcggccgtaacatcatgatgggctaccttgccaaccccaagcttggcgacgaccacgttgccgagatcgaggagaagaacgctgccgctatcgactccgagggctggctccacagtggtgataagggcgccatttctacccgcggcatgctcaagatcacgggccgctacaaggagctcatcatcggcgccggtggcgagaacgtggcgcccgtccctattgaggacgccatcaaggcgcgcatgccttttgtttccaacgccatgatggtcggagataagcgcaagttcatggctgtcctccttaccctcaagacggttggcgccacgggcgagcttcccggtacgaacaagctcatgggcgctgccgccgactacggtgagaccatcgaggacgcctgcgacaacgaggcgctcattgaggagatcacgcagcagctcaaggagatcggtgatgatggcgatgtcacgccctcgaacgcggctcgcatccaaaagttcaccattctcccgctcgacttttccgtctccacggacgagctcacggccacgctcaagctcaagcgctccgtggtcgcagacaagtacgaagacatcatcgaggccttttacgagtccaagagcgtttttgtgccgtactcgaccgttggcgcctacgccacgggcggcccggtcgacgactccgttgtcgatggctcattcaagggcgactttagcatgattggcgacgatgatccggatcttcaaaacgtcgatgtcctcgaggcgattgacgaggacaattaagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatccctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 46 - DNA, 34862 bp, Artificial sequence
  plasmid pDAB9166
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcgaattcggaaatgggccaagtgaaatggaaatagagcttcaatccatttagtcccactcaaaatggtgctcgaattatatttagttacgttcgaatcagacaaccaagtatttggttaataaaaaccactcgcaacaaaggaaaaacaccaagcgcgtgcgtccaacatccgacggaaggggggtaatgtggtccgaaaaccttacaaaaatctgacgtcatctacccccgaaaacgttgaatcgtcaacgggggtagttttcgaattatcttttttttaggggcagttttattaatttgctctagaaattttatgattttaattaaaaaaagaaaaagaatatttgtatatttattttttatactctttttttgtccaactatttctcttattttggcaactttaactagactagtaacttatgtcaatgtgtatggatgcatgagagtgagtatacacatgtctaaatgcatgccttatgaaagcaacgcaccacaaaacgaagacccctttacaaatacatctcatcccttagtaccctcttactactgtcccgacacaaactcaaaacaaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcgaattcggaaatgggccaagtgaaatggaaatagagcttcaatccatttagtcccactcaaaatggtgctcgaattatatttagttacgttcgaatcagacaaccaagtatttggttaataaaaaccactcgcaacaaaggaaaaacaccaagcgcgtgcgtccaacatccgacggaaggggggtaatgtggtccgaaaaccttacaaaaatctgacgtcatctacccccgaaaacgttgaatcgtcaacgggggtagttttcgaattatcttttttttaggggcagttttattaatttgctctagaaattttatgattttaattaaaaaaagaaaaagaatatttgtatatttattttttatactctttttttgtccaactatttctcttattttggcaactttaactagactagtaacttatgtcaatgtgtatggatgcatgagagtgagtatacacatgtctaaatgcatgccttatgaaagcaacgcaccacaaaacgaagacccctttacaaatacatctcatcccttagtaccctcttactactgtcccgacacaaactcaaaacaaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcgcggccgcgaattcggaaatgggccaagtgaaatggaaatagagcttcaatccatttagtcccactcaaaatggtgctcgaattatatttagttacgttcgaatcagacaaccaagtatttggttaataaaaaccactcgcaacaaaggaaaaacaccaagcgcgtgcgtccaacatccgacggaaggggggtaatgtggtccgaaaaccttacaaaaatctgacgtcatctacccccgaaaacgttgaatcgtcaacgggggtagttttcgaattatcttttttttaggggcagttttattaatttgctctagaaattttatgattttaattaaaaaaagaaaaagaatatttgtatatttattttttatactctttttttgtccaactatttctcttattttggcaactttaactagactagtaacttatgtcaatgtgtatggatgcatgagagtgagtatacacatgtctaaatgcatgccttatgaaagcaacgcaccacaaaacgaagacccctttacaaatacatctcatcccttagtaccctcttactactgtcccgacacaaactcaaaacaaggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcgaattcggaaatgggccaagtgaaatggaaatagagcttcaatccatttagtcccactcaaaatggtgctcgaattatatttagttacgttcgaatcagacaaccaagtatttggttaataaaaaccactcgcaacaaaggaaaaacaccaagcgcgtgcgtccaacatccgacggaaggggggtaatgtggtccgaaaaccttacaaaaatctgacgtcatctacccccgaaaacgttgaatcgtcaacgggggtagttttcgaattatcttttttttaggggcagttttattaatttgctctagaaattttatgattttaattaaaaaaagaaaaagaatatttgtatatttattttttatactctttttttgtccaactatttctcttattttggcaactttaactagactagtaacttatgtcaatgtgtatggatgcatgagagtgagtatacacatgtctaaatgcatgccttatgaaagcaacgcaccacaaaacgaagacccctttacaaatacatctcatcccttagtaccctcttactactgtcccgacacaaactcaaaacaaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 47 - DNA, 34404 bp, Artificial sequence
  plasmid pDAB9167
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcgaattcggaaatgggccaagtgaaatggaaatagagcttcaatccatttagtcccactcaaaatggtgctcgaattatatttagttacgttcgaatcagacaaccaagtatttggttaataaaaaccactcgcaacaaaggaaaaacaccaagcgcgtgcgtccaacatccgacggaaggggggtaatgtggtccgaaaaccttacaaaaatctgacgtcatctacccccgaaaacgttgaatcgtcaacgggggtagttttcgaattatcttttttttaggggcagttttattaatttgctctagaaattttatgattttaattaaaaaaagaaaaagaatatttgtatatttattttttatactctttttttgtccaactatttctcttattttggcaactttaactagactagtaacttatgtcaatgtgtatggatgcatgagagtgagtatacacatgtctaaatgcatgccttatgaaagcaacgcaccacaaaacgaagacccctttacaaatacatctcatcccttagtaccctcttactactgtcccgacacaaactcaaaacaaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagatctgattggtaagatatgggtactgtttggtttatatgttttgactattcagtcactatggcccccataaattttaattcggctggtatgtctcggttaagaccggtttgacatggttcatttcagttcaattatgttaatctggcacgtgatatgtttaccttcacacgaacattagtaatgatgggctaatttaagacttaacaggcctagagaggcccatcttattacgtaacggcgtcgtttagagtgcaccaagcttataaatgaaaacgagctacctcgggacatcacgctctttgtacactccgccatctctctctctcgttggagcagatctctctcgtgaatatcgacaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcgcggccgcgaattcggaaatgggccaagtgaaatggaaatagagcttcaatccatttagtcccactcaaaatggtgctcgaattatatttagttacgttcgaatcagacaaccaagtatttggttaataaaaaccactcgcaacaaaggaaaaacaccaagcgcgtgcgtccaacatccgacggaaggggggtaatgtggtccgaaaaccttacaaaaatctgacgtcatctacccccgaaaacgttgaatcgtcaacgggggtagttttcgaattatcttttttttaggggcagttttattaatttgctctagaaattttatgattttaattaaaaaaagaaaaagaatatttgtatatttattttttatactctttttttgtccaactatttctcttattttggcaactttaactagactagtaacttatgtcaatgtgtatggatgcatgagagtgagtatacacatgtctaaatgcatgccttatgaaagcaacgcaccacaaaacgaagacccctttacaaatacatctcatcccttagtaccctcttactactgtcccgacacaaactcaaaacaaggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagatctgattggtaagatatgggtactgtttggtttatatgttttgactattcagtcactatggcccccataaattttaattcggctggtatgtctcggttaagaccggtttgacatggttcatttcagttcaattatgttaatctggcacgtgatatgtttaccttcacacgaacattagtaatgatgggctaatttaagacttaacaggcctagagaggcccatcttattacgtaacggcgtcgtttagagtgcaccaagcttataaatgaaaacgagctacctcgggacatcacgctctttgtacactccgccatctctctctctcgttggagcagatctctctcgtgaatatcgacaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 48 - DNA, 38762 bp, Artificial sequence
  plasmid pDAB7379
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgacacccagcttt

SEQ ID NO: 49 - DNA, 35836 bp, Artificial sequence
  plasmid pDAB7380
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgaccaacttttctatacaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatcacgagtggatgactgtcacgactgactcatgactgactactagtgctagcctcgaggtcgacacaactttgtataataaagttgtctagtctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgacacccagcttt

SEQ ID NO: 50 - DNA, 47165 bp, Artificial sequence
  plasmid pDAB9323
gtacaaaaaagcaggcttctagacctagctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcggcccgtctgcaggagcaaaagggaggcgagatggatacccgcattgccatcatcggcatgtcggccatcctcccctgcggcacgaccgtgcgcgagtcgtgggagaccatccgcgccggcatcgactgcctgtcggatctccccgaggaccgcgtcgacgtgacggcgtactttgaccccgtcaagaccaccaaggacaagatctactgcaagcgcggtggcttcattcccgagtacgactttgacgcccgcgagttcggactcaacatgttccagatggaggactcggacgcaaaccagaccatctcgcttctcaaggtcaaggaggccctccaggacgccggcatcgacgccctcggcaaggaaaagaagaacatcggctgcgtgctcggcattggcggcggccaaaagtccagccacgagttctactcgcgccttaattatgttgtcgtggagaaggtcctccgcaagatgggcatgcccgaggaggacgtcaaggtcgccgtcgaaaagtacaaggccaacttccccgagtggcgcctcgactccttccctggcttcctcggcaacgtcaccgccggtcgctgcaccaacaccttcaacctcgacggcatgaactgcgttgtcgacgccgcatgcgcctcgtccctcatcgccgtcaaggtcgccatcgacgagctgctctacggtgactgcgacatgatggtcaccggtgccacctgcacggataactccatcggcatgtacatggccttctccaagacccccgtgttctccacggaccccagcgtgcgcgcctacgacgaaaagacaaagggcatgctcatcggcgagggctccgccatgctcgtcctcaagcgctacgccgacgccgtccgcgacggcgatgagatccacgctgttattcgcggctgcgcctcctccagtgatggcaaggccgccggcatctacacgcccaccatttcgggccaggaggaggccctccgccgcgcctacaaccgcgcctgtgtcgacccggccaccgtcactctcgtcgagggtcacggcaccggtactcccgttggcgaccgcatcgagctcaccgccttgcgcaacctctttgacaaggcctacggcgagggcaacaccgaaaaggtcgctgtgggcagcatcaagtccagcatcggccatctcaaggccgtcgccggtctcgccggtatgatcaaggtcatcatggcgctcaagcacaagactctcccgggcaccatcaacgtcgacaacccacccaacctctacgacaacacgcccatcaacgagtcctcgctctacattaacaccatgaaccgcccctggttcccgccccctggtgtgccccgccgcgccggcatttcgagctttggctttggtggcgccaactaccacgccgtcctcgaggaggccgagcccgagcacacgaccgcgtaccgcctcaacaagcgcccgcagcccgtgctcatgatggccgccacgcccgcggccctccagtcgctctgcgaggcccagctcaaggagttcgaggccgccatcaaggagaacgagaccgtcaagaacaccgcctacatcaagtgcgtcaagttcggcgagcagttcaaattccctggctccatcccggccacaaacgcgcgcctcggcttcctcgtcaaggatgctgaggatgcctgctccaccctccgtgccatctgcgcccaattcgccaaggatgtcaccaaggaggcctggcgcctcccccgcgagggcgtcagcttccgcgccaagggcatcgccaccaacggcgctgtcgccgcgctcttctccggccagggcgcgcagtacacgcacatgtttagcgaggtggccatgaactggccccagttccgccagagcattgccgccatggacgccgcccagtccaaggtcgctggaagcgacaaggactttgagcgcgtctcccaggtcctctacccgcgcaagccgtacgagcgtgagcccgagcaggaccacaagaagatctccctcaccgcctactcgcagccctcgaccctggcctgcgctctcggtgcctttgagatcttcaaggaggccggcttcaccccggactttgccgccggccattcgctcggtgagttcgccgccctctacgccgcgggctgcgtcgaccgcgacgagctctttgagcttgtctgccgccgcgcccgcatcatgggcggcaaggacgcaccggccacccccaagggctgcatggccgccgtcattggccccaacgccgagaacatcaaggtccaggccgccaacgtctggctcggcaactccaactcgccttcgcagaccgtcatcaccggctccgtcgaaggtatccaggccgagagcgcccgcctccagaaggagggcttccgcgtcgtgcctcttgcctgcgagagcgccttccactcgccccagatggagaacgcctcgtcggccttcaaggacgtcatctccaaggtctccttccgcacccccaaggccgagaccaagctcttcagcaacgtctctggcgagacctaccccacggacgcccgcgagatgcttacgcagcacatgaccagcagcgtcaagttcctcacccaggtccgcaacatgcaccaggccggtgcgcgcatctttgtcgagttcggacccaagcaggtgctctccaagcttgtctccgagaccctcaaggatgacccctcggttgtcaccgtctctgtcaacccggcctcgggcacggattcggacatccagctccgcgacgcggccgtccagctcgttgtcgctggcgtcaaccttcagggctttgacaagtgggacgcccccgatgccacccgcatgcaggccatcaagaagaagcgcactaccctccgcctttcggccgccacctacgtctcggacaagaccaagaaggtccgcgacgccgccatgaacgatggccgctgcgtcacctacctcaagggcgccgcaccgctcatcaaggccccggagcccgttgtcgacgaggccgccaagcgcgaggccgagcgtctccagaaggagcttcaggatgcccagcgccagctcgacgacgccaagcgcgccgccgccgaggccaactccaagctcgccgctgccaaggaggaggccaagaccgccgctgcttcggccaagcccgcagttgacactgctgttgtcgaaaagcatcgtgccatcctcaagtccatgctcgcggagctcgatggctacggatcggtcgacgcttcttccctccagcagcagcagcagcagcagacggcccccgccccggtcaaggctgctgcgcctgccgcccccgttgcctcggcccctgccccggctgtctcgaacgagcttcttgagaaggccgagactgtcgtcatggaggtcctcgccgccaagaccggctacgagaccgacatgatcgaggctgacatggagctcgagaccgagctcggcattgactccatcaagcgtgtcgagatcctctccgaggtccaggccatgctcaatgtcgaggccaaggatgtcgatgccctcagccgcactcgcactgttggtgaggttgtcaacgccatgaaggccgagatcgctggcagctctgccccggcgcctgctgccgctgctccggctccggccaaggctgcccctgccgccgctgcgcctgctgtctcgaacgagcttctcgagaaggccgagaccgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgacgctctcagccgcactcgcactgtgggtgaggtcgtcaacgccatgaaggctgagatcgctggtggctctgccccggcgcctgccgccgctgccccaggtccggctgctgccgcccctgcgcctgccgccgccgcccctgctgtctcgaacgagcttcttgagaaggccgagaccgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgctgtctcgagcgagcttctcgagaaggccgagactgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgccgcccctgcgcctgctgtctcgagcgagcttctcgagaaggccgagactgtcgtcatggaggtcctcgccgccaagactggctacgagactgacatgattgagtccgacatggagctcgagaccgagctcggcattgactccatcaagcgtgtcgagattctctccgaggttcaggccatgctcaacgtcgaggccaaggacgtcgacgctctcagccgcactcgcactgttggtgaggtcgtcgatgccatgaaggctgagatcgctggcagctccgcctcggcgcctgccgccgctgctcctgctccggctgctgccgctcctgcgcccgctgccgccgcccctgctgtctcgaacgagcttctcgagaaagccgagactgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttctcgagaaggccgagactgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgatgctctcagccgcactcgcactgttggcgaggtcgtcgatgccatgaaggctgagatcgccggcagctccgccccggcgcctgccgccgctgctcctgctccggctgctgccgctcctgcgcccgctgccgctgcccctgctgtctcgagcgagcttctcgagaaggccgagaccgtcgtcatggaggtcctcgccgccaagactggctacgagactgacatgattgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttcttgagaaggccgagaccgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgacgctctcagccgcactcgcactgttggcgaggtcgtcgatgccatgaaggctgagatcgctggtggctctgccccggcgcctgccgccgctgctcctgcctcggctggcgccgcgcctgcggtcaagattgactcggtccacggcgctgactgtgatgatctttccctgatgcacgccaaggtggttgacatccgccgcccggacgagctcatcctggagcgccccgagaaccgccccgttctcgttgtcgatgacggcagcgagctcaccctcgccctggtccgcgtcctcggcgcctgcgccgttgtcctgacctttgagggtctccagctcgctcagcgcgctggtgccgctgccatccgccacgtgctcgccaaggatctttccgcggagagcgccgagaaggccatcaaggaggccgagcagcgctttggcgctctcggcggcttcatctcgcagcaggcggagcgcttcgagcccgccgaaatcctcggcttcacgctcatgtgcgccaagttcgccaaggcttccctctgcacggctgtggctggcggccgcccggcctttatcggtgtggcgcgccttgacggccgcctcggattcacttcgcagggcacttctgacgcgctcaagcgtgcccagcgtggtgccatctttggcctctgcaagaccatcggcctcgagtggtccgagtctgacgtcttttcccgcggcgtggacattgctcagggcatgcaccccgaggatgccgccgtggcgattgtgcgcgagatggcgtgcgctgacattcgcattcgcgaggtcggcattggcgcaaaccagcagcgctgcacgatccgtgccgccaagctcgagaccggcaacccgcagcgccagatcgccaaggacgacgtgctgctcgtttctggcggcgctcgcggcatcacgcctctttgcatccgggagatcacgcgccagatcgcgggcggcaagtacattctgcttggccgcagcaaggtctctgcgagcgaaccggcatggtgcgctggcatcactgacgagaaggctgtgcaaaaggctgctacccaggagctcaagcgcgcctttagcgctggcgagggccccaagcccacgccccgcgctgtcactaagcttgtgggctctgttcttggcgctcgcgaggtgcgcagctctattgctgcgattgaagcgctcggcggcaaggccatctactcgtcgtgcgacgtgaactctgccgccgacgtggccaaggccgtgcgcgatgccgagtcccagctcggtgcccgcgtctcgggcatcgttcatgcctcgggcgtgctccgcgaccgtctcatcgagaagaagctccccgacgagttcgacgccgtctttggcaccaaggtcaccggtctcgagaacctcctcgccgccgtcgaccgcgccaacctcaagcacatggtcctcttcagctcgctcgccggcttccacggcaacgtcggccagtctgactacgccatggccaacgaggcccttaacaagatgggcctcgagctcgccaaggacgtctcggtcaagtcgatctgcttcggtccctgggacggtggcatggtgacgccgcagctcaagaagcagttccaggagatgggcgtgcagatcatcccccgcgagggcggcgctgataccgtggcgcgcatcgtgctcggctcctcgccggctgagatccttgtcggcaactggcgcaccccgtccaagaaggtcggctcggacaccatcaccctgcaccgcaagatttccgccaagtccaaccccttcctcgaggaccacgtcatccagggccgccgcgtgctgcccatgacgctggccattggctcgctcgcggagacctgcctcggcctcttccccggctactcgctctgggccattgacgacgcccagctcttcaagggtgtcactgtcgacggcgacgtcaactgcgaggtgaccctcaccccgtcgacggcgccctcgggccgcgtcaacgtccaggccacgctcaagaccttttccagcggcaagctggtcccggcctaccgcgccgtcatcgtgctctccaaccagggcgcgcccccggccaacgccaccatgcagccgccctcgctcgatgccgatccggcgctccagggctccgtctacgacggcaagaccctcttccacggcccggccttccgcggcatcgatgacgtgctctcgtgcaccaagagccagcttgtggccaagtgcagcgctgtccccggctccgacgccgctcgcggcgagtttgccacggacactgacgcccatgaccccttcgtgaacgacctggcctttcaggccatgctcgtctgggtgcgccgcacgctcggccaggctgcgctccccaactcgatccagcgcatcgtccagcaccgcccggtcccgcaggacaagcccttctacattaccctccgctccaaccagtcgggcggtcactcccagcacaagcacgcccttcagttccacaacgagcagggcgatctcttcattgatgtccaggcttcggtcatcgccacggacagccttgccttctaaatctaaactaggccatggtgacttaaggtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccggccatctaggccggatccacaaccaaaaatggccgctcgcaacgtgtctgcagcgcatgagatgcacgatgaaaagcgcatcgccgtcgtcggcatggccgtccagtacgccggatgcaaaaccaaggacgagttctgggaggtgctcatgaacggcaaggtcgagtccaaggtgatcagcgacaaacgactcggctccaactaccgcgccgagcactacaaagcagagcgcagcaagtatgccgacaccttttgcaacgaaacgtacggcacccttgacgagaacgagatcgacaacgagcacgaactcctcctcaacctcgccaagcaggcactcgcagagacatccgtcaaagactcgacacgctgcggcatcgtcagcggctgcctctcgttccccatggacaacctccagggtgaactcctcaacgtgtaccaaaaccatgtcgagaaaaagctcggggcccgcgtcttcaaggacgcctcccattggtccgaacgcgagcagtccaacaaacccgaggccggtgaccgccgcatcttcatggacccggcctccttcgtcgccgaagaactcaacctcggcgcccttcactactccgtcgacgcagcatgcgccacggcgctctacgtgctccgcctcgcgcaggatcatctcgtctccggcgccgccgacgtcatgctctgcggtgccacctgcctgccggagccctttttcatcctttcgggcttttccaccttccaggccatgcccgtcggcacgggccagaacgtgtccatgccgctgcacaaggacagccagggcctcaccccgggtgagggcggctccatcatggtcctcaagcgtctcgatgatgccatccgcgacggcgaccacatctacggcacccttctcggcgccaatgtcagcaactccggcacaggtctgcccctcaagccccttctccccagcgagaaaaagtgcctcatggacacctacacgcgcattaacgtgcacccgcacaagattcagtacgtcgagtgccacgccaccggcacgccccagggtgatcgtgtggaaatcgacgccgtcaaggcctgctttgaaggcaaggtcccccgtttcggtaccacaaagggcaactttggacacaccctcgtcgcagccggctttgccggtatgtgcaaggtcctcctctccatgaagcatggcatcatcccgcccaccccgggtatcgatgacgagaccaagatggaccctctcgtcgtctccggtgaggccatcccatggccagagaccaacggcgagcccaagcgcgccggtctctcggcctttggctttggtggcaccaacgcccatgccgtctttgaggagcatgacccctccaacgccgcctgcacgggccacgactccatttctgcgctctcggcccgctgcggcggtgaaagcaacatgcgcatcgccatcactggtatggacgccacctttggcgctctcaagggactcgacgccttcgagcgcgccatttacaccggcgctcacggtgccatcccactcccagaaaagcgctggcgctttctcggcaaggacaaggactttcttgacctctgcggcgtcaaggccaccccgcacggctgctacattgaagatgttgaggtcgacttccagcgcctccgcacgcccatgacccctgaagacatgctcctccctcagcagcttctggccgtcaccaccattgaccgcgccatcctcgactcgggaatgaaaaagggtggcaatgtcgccgtctttgtcggcctcggcaccgacctcgagctctaccgtcaccgtgctcgcgtcgctctcaaggagcgcgtccgccctgaagcctccaagaagctcaatgacatgatgcagtacattaacgactgcggcacatccacatcgtacacctcgtacattggcaacctcgtcgccacgcgcgtctcgtcgcagtggggcttcacgggcccctcctttacgatcaccgagggcaacaactccgtctaccgctgcgccgagctcggcaagtacctcctcgagaccggcgaggtcgatggcgtcgtcgttgcgggtgtcgatctctgcggcagtgccgaaaacctttacgtcaagtctcgccgcttcaaggtgtccacctccgataccccgcgcgccagctttgacgccgccgccgatggctactttgtcggcgagggctgcggtgcctttgtgctcaagcgtgagactagctgcaccaaggacgaccgtatctacgcttgcatggatgccatcgtccctggcaacgtccctagcgcctgcttgcgcgaggccctcgaccaggcgcgcgtcaagccgggcgatatcgagatgctcgagctcagcgccgactccgcccgccacctcaaggacccgtccgtcctgcccaaggagctcactgccgaggaggaaatcggcggccttcagacgatccttcgtgacgatgacaagctcccgcgcaacgtcgcaacgggcagtgtcaaggccaccgtcggtgacaccggttatgcctctggtgctgccagcctcatcaaggctgcgctttgcatctacaaccgctacctgcccagcaacggcgacgactgggatgaacccgcccctgaggcgccctgggacagcaccctctttgcgtgccagacctcgcgcgcttggctcaagaaccctggcgagcgtcgctatgcggccgtctcgggcgtctccgagacgcgctcgtgctattccgtgctcctctccgaagccgagggccactacgagcgcgagaaccgcatctcgctcgacgaggaggcgcccaagctcattgtgcttcgcgccgactcccacgaggagatccttggtcgcctcgacaagatccgcgagcgcttcttgcagcccacgggcgccgccccgcgcgagtccgagctcaaggcgcaggcccgccgcatcttcctcgagctcctcggcgagacccttgcccaggatgccgcttcttcaggctcgcaaaagcccctcgctctcagcctcgtctccacgccctccaagctccagcgcgaggtcgagctcgcggccaagggtatcccgcgctgcctcaagatgcgccgcgattggagctcccctgctggcagccgctacgcgcctgagccgctcgccagcgaccgcgtcgccttcatgtacggcgaaggtcgcagcccttactacggcatcacccaagacattcaccgcatttggcccgaactccacgaggtcatcaacgaaaagacgaaccgtctctgggccgaaggcgaccgctgggtcatgccgcgcgccagcttcaagtcggagctcgagagccagcagcaagagtttgatcgcaacatgattgaaatgttccgtcttggaatcctcacctcaattgccttcaccaatctggcgcgcgacgttctcaacatcacgcccaaggccgcctttggcctcagtcttggcgagatttccatgatttttgccttttccaagaagaacggtctcatctccgaccagctcaccaaggatcttcgcgagtccgacgtgtggaacaaggctctggccgttgaatttaatgcgctgcgcgaggcctggggcattccacagagtgtccccaaggacgagttctggcaaggctacattgtgcgcggcaccaagcaggatatcgaggcggccatcgccccggacagcaagtacgtgcgcctcaccatcatcaatgatgccaacaccgccctcattagcggcaagcccgacgcctgcaaggctgcgatcgcgcgtctcggtggcaacattcctgcgcttcccgtgacccagggcatgtgcggccactgccccgaggtgggaccttataccaaggatatcgccaagatccatgccaaccttgagttccccgttgtcgacggccttgacctctggaccacaatcaaccagaagcgcctcgtgccacgcgccacgggcgccaaggacgaatgggccccttcttcctttggcgagtacgccggccagctctacgagaagcaggctaacttcccccaaatcgtcgagaccatttacaagcaaaactacgacgtctttgtcgaggttgggcccaacaaccaccgtagcaccgcagtgcgcaccacgcttggtccccagcgcaaccaccttgctggcgccatcgacaagcagaacgaggatgcttggacgaccatcgtcaagcttgtggcttcgctcaaggcccaccttgttcctggcgtcacgatctcgccgctgtaccactccaagcttgtggcggaggctgaggcttgctacgctgcgctctgcaagggtgaaaagcccaagaagaacaagtttgtgcgcaagattcagctcaacggtcgcttcaacagcaaggcggaccccatctcctcggccgatcttgccagctttccgcctgcggaccctgccattgaagccgccatctcgagccgcatcatgaagccggttgctccgaagttctacgcgcgtctcaacattgacgagcaggacgagacccgtgatccgatcctcaacaaggacaacgcgccgtcttccagctctagctcctcttccagctcttccagctcttccagcccgtcgccagctccgtccgccccagtgcaaaagaaggctgctccggccgcggagaccaaggctgttgcttcggctgacgcacttcgcagtgccctgctcgatctcgacagtatgcttgcgctgagctctgccagtgcctccggcaaccttgttgagactgcgcctagcgacgcctcggtcattgtgccgccctgcaacattgcggatctcggcagccgcgccttcatgaaaacgtacggtgtttcggcgcctctgtacacgggcgccatggccaagggcattgcctctgcggacctcgtcattgccgccggccgccagggcatccttgcgtcctttggcgccggcggacttcccatgcaggttgtgcgtgagtccatcgaaaagattcaggccgccctgcccaatggcccgtacgctgtcaaccttatccattctccctttgacagcaacctcgaaaagggcaatgtcgatctcttcctcgagaagggtgtcacctttgtcgaggcctcggcctttatgacgctcaccccgcaggtcgtgcggtaccgcgcggctggcctcacgcgcaacgccgacggctcggtcaacatccgcaaccgtatcattggcaaggtctcgcgcaccgagctcgccgagatgttcatgcgtcctgcgcccgagcaccttcttcagaagctcattgcttccggcgagatcaaccaggagcaggccgagctcgcccgccgtgttcccgtcgctgacgacatcgcggtcgaagctgactcgggtggccacaccgacaaccgccccatccacgtcattctgcccctcatcatcaaccttcgcgaccgccttcaccgcgagtgcggctacccggccaaccttcgcgtccgtgtgggcgccggcggtggcattgggtgcccccaggcggcgctggccaccttcaacatgggtgcctcctttattgtcaccggcaccgtgaaccaggtcgccaagcagtcgggcacgtgcgacaatgtgcgcaagcagctcgcgaaggccacttactcggacgtatgcatggccccggctgccgacatgttcgaggaaggcgtcaagcttcaggtcctcaagaagggaaccatgtttccctcgcgcgccaacaagctctacgagctcttttgcaagtacgactcgttcgagtccatgccccccgcagagcttgcgcgcgtcgagaagcgcatcttcagccgcgcgctcgaagaggtctgggacgagaccaaaaacttttacattaaccgtcttcacaacccggagaagatccagcgcgccgagcgcgaccccaagctcaagatgtcgctgtgctttcgctggtacctgagcctggcgagccgctgggccaacactggagcttccgatcgcgtcatggactaccaggtctggtgcggtcctgccattggttccttcaacgatttcatcaagggaacttaccttgatccggccgtcgcaaacgagtacccgtgcgtcgttcagattaacaagcagatccttcgtggagcgtgcttcttgcgccgtctcgaaattctgcgcaacgcacgcctttccgatggcgctgccgctcttgtggccagcatcgatgacacatacgtcccggccgagaagctgtgagtagttagcttaatcacttaggtcaccggcctagtaggccggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccggccatctaggccggatccacaaccaaaaatggcgctccgtgtcaagacgaacaagaagccatgctgggagatgaccaaggaggagctgaccagcggcaagaccgaggtgttcaactatgaggaactcctcgagttcgcagagggcgacatcgccaaggtcttcggacccgagttcgccgtcatcgacaagtacccgcgccgcgtgcgcctgcccgcccgcgagtacctgctcgtgacccgcgtcaccctcatggacgccgaggtcaacaactaccgcgtcggcgcccgcatggtcaccgagtacgatctccccgtcaacggagagctctccgagggcggagactgcccctgggccgtcctggtcgagagtggccagtgcgatctcatgctcatctcctacatgggcattgacttccagaaccagggcgaccgcgtctaccgcctgctcaacaccacgctcaccttttacggcgtggcccacgagggcgagaccctcgagtacgacattcgcgtcaccggcttcgccaagcgtctcgacggcggcatctccatgttcttcttcgagtacgactgctacgtcaacggccgcctcctcatcgagatgcgcgatggctgcgccggcttcttcaccaacgaggagctcgacgccggcaagggcgtcgtcttcacccgcggcgacctcgccgcccgcgccaagatcccaaagcaggacgtctccccctacgccgtcgccccctgcctccacaagaccaagctcaacgaaaaggagatgcagaccctcgtcgacaaggactgggcatccgtctttggctccaagaacggcatgccggaaatcaactacaaactctgcgcgcgtaagatgctcatgattgaccgcgtcaccagcattgaccacaagggcggtgtctacggcctcggtcagctcgtcggtgaaaagatcctcgagcgcgaccactggtactttccctgccactttgtcaaggatcaggtcatggccggatccctcgtctccgacggctgcagccagatgctcaagatgtacatgatctggctcggcctccacctcaccaccggaccctttgacttccgcccggtcaacggccaccccaacaaggtccgctgccgcggccaaatctccccgcacaagggcaagctcgtctacgtcatggagatcaaggagatgggcttcgacgaggacaacgacccgtacgccattgccgacgtcaacatcattgatgtcgacttcgaaaagggccaggactttagcctcgaccgcatcagcgactacggcaagggcgacctcaacaagaagatcgtcgtcgactttaagggcatcgctctcaagatgcagaagcgctccaccaacaagaacccctccaaggttcagcccgtctttgccaacggcgccgccactgtcggccccgaggcctccaaggcttcctccggcgccagcgccagcgccagcgccgccccggccaagcctgccttcagcgccgatgttcttgcgcccaagcccgttgcccttcccgagcacatcctcaagggcgacgccctcgcccccaaggagatgtcctggcaccccatggcccgcatcccgggcaacccgacgccctcttttgcgccctcggcctacaagccgcgcaacatcgcctttacgcccttccccggcaaccccaacgataacgaccacaccccgggcaagatgccgctcacctggttcaacatggccgagttcatggccggcaaggtcagcatgtgcctcggccccgagttcgccaagttcgacgactcgaacaccagccgcagccccgcttgggacctcgctctcgtcacccgcgccgtgtctgtgtctgacctcaagcacgtcaactaccgcaacatcgacctcgacccctccaagggtaccatggtcggcgagttcgactgccccgcggacgcctggttctacaagggcgcctgcaacgatgcccacatgccgtactcgatcctcatggagatcgccctccagacctcgggtgtgctcacctcggtgctcaaggcgcccctgaccatggagaaggacgacatcctcttccgcaacctcgacgccaacgccgagttcgtgcgcgccgacctcgactaccgcggcaagactatccgcaacgtcaccaagtgcactggctacagcatgctcggcgagatgggcgtccaccgcttcacctttgagctctacgtcgatgatgtgctcttttacaagggctcgacctcgttcggctggttcgtgcccgaggtctttgccgcccaggccggcctcgacaacggccgcaagtcggagccctggttcattgagaacaaggttccggcctcgcaggtctcctcctttgacgtgcgccccaacggcagcggccgcaccgccatcttcgccaacgcccccagcggcgcccagctcaaccgccgcacggaccagggccagtacctcgacgccgtcgacattgtctccggcagcggcaagaagagcctcggctacgcccacggttccaagacggtcaacccgaacgactggttcttctcgtgccacttttggtttgactcggtcatgcccggaagtctcggtgtcgagtccatgttccagctcgtcgaggccatcgccgcccacgaggatctcgctggcaagcacggcattgccaaccccacctttgtgcacgccccgggcaagatcagctggaagtaccgcggccagctcacgcccaagagcaagaagatggactcggaggtccacatcgtgtccgtggacgcccacgacggcgttgtcgacctcgtcgccgacggcttcctctgggccgacagcctccgcgtctactcggtgagcaacattcgcgtgcgcatcgcctccggtgaggcccctgccgccgcctcctccgccgcctctgtgggctcctcggcttcgtccgtcgagcgcacgcgctcgagccccgctgtcgcctccggcccggcccagaccatcgacctcaagcagctcaagaccgagctcctcgagctcgatgccccgctctacctctcgcaggacccgaccagcggccagctcaagaagcacaccgacgtggcctccggccaggccaccatcgtgcagccctgcacgctcggcgacctcggtgaccgctccttcatggagacctacggcgtcgtcgccccgctgtacacgggcgccatggccaagggcattgcctcggcggacctcgtcatcgccgccggcaagcgcaagatcctcggctcctttggcgccggcggcctccccatgcaccacgtgcgcgccgccctcgagaagatccaggccgccctgcctcagggcccctacgccgtcaacctcatccactcgccttttgacagcaacctcgagaagggcaacgtcgatctcttcctcgagaagggcgtcactgtggtggaggcctcggcattcatgaccctcaccccgcaggtcgtgcgctaccgcgccgccggcctctcgcgcaacgccgacggttcggtcaacatccgcaaccgcatcatcggcaaggtctcgcgcaccgagctcgccgagatgttcatccgcccggccccggagcacctcctcgagaagctcatcgcctcgggcgagatcacccaggagcaggccgagctcgcgcgccgcgttcccgtcgccgacgatatcgctgtcgaggctgactcgggcggccacaccgacaaccgccccatccacgtcatcctcccgctcatcatcaacctccgcaaccgcctgcaccgcgagtgcggctaccccgcgcacctccgcgtccgcgttggcgccggcggtggcgtcggctgcccgcaggccgccgccgccgcgctcaccatgggcgccgccttcatcgtcaccggcactgtcaaccaggtcgccaagcagtccggcacctgcgacaacgtgcgcaagcagctctcgcaggccacctactcggatatctgcatggccccggccgccgacatgttcgaggagggcgtcaagctccaggtcctcaagaagggaaccatgttcccctcgcgcgccaacaagctctacgagctcttttgcaagtacgactccttcgactccatgcctcctgccgagctcgagcgcatcgagaagcgtatcttcaagcgcgcactccaggaggtctgggaggagaccaaggacttttacattaacggtctcaagaacccggagaagatccagcgcgccgagcacgaccccaagctcaagatgtcgctctgcttccgctggtaccttggtcttgccagccgctgggccaacatgggcgccccggaccgcgtcatggactaccaggtctggtgtggcccggccattggcgccttcaacgacttcatcaagggcacctacctcgaccccgctgtctccaacgagtacccctgtgtcgtccagatcaacctgcaaatcctccgtggtgcctgctacctgcgccgtctcaacgccctgcgcaacgacccgcgcattgacctcgagaccgaggatgctgcctttgtctacgagcccaccaacgcgctctaatgagtagttagcttaatcacttaggtcaccggcctagtaggccggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccggccatctaggccggatccacaaccaaaaatggctcccactcccgacgccaccgcgcctctgaacaagccgagcgactatgccgtctaccacgaggaagacggccccttctggaccgccgattccagcggcgtctcgcgcgtgaactttagcgagaccggcgtgggatccgagggcgtcatccctgcgctcacgctcatcgacgtcttcgagagggccgtcaagcgcggcggaaacaggatcgccttccgcacggaaaacatgcccacgctccgccgcggcgaagaggccccggacgcgctgccgctcaaggactggaagtcctggtcctggaaacagtacaaggccgacgtccaccgcatcgccagggctctcatggacctcggcgttgagcagcatgacgccgtctccatttttggctttaactcgcccgaatggtttctcagtgccgtcggcgccgtgcacgcaggtgccaagattgccggcatttacccctcagacacgcccgcccaggtccagtacaaggccttccacagtgacaccgctgttgccgttgtcgaaaacgagcagtgcttcaagaagttcgccgaggtcgtcgaggaccttccttacctcaaggccattgtttgctgggactatgaagccacagacatcacgcgcgaggacggctccgtcgtcgaggtcctcacctttgccgagttcctcaagcgcggcgacaccgtcgaggcggccgcccttgacgagcgcatctccaagatcgagcccaccatgtgcgctgcccttatttacaccagcggtactaccggccgccccaaggccgttatgatttcgcacgacaaccttgttttcgaggccagcgccgtcgtccccaacctcggaggagcctgtacgaccactgctgaggagcgcattctctcgtacctgcctctctcgcacgtcgctggtatgatggttgatattattgcccccatcattgccaccgccttccacaagggccgcatctgcgtctgctttgctcgcccgtacgatttgcgcaccggcacgctgggccagcgcctcaacgccgtggagcccaccatcttccttggcgtgccccgtgtgtgggaaaagattcaggaaaagctcatggccgtcggtgccaaaaccaccggcctcaagaagaagctctctacggccgccaagaagcgtggtcttgaattccaggaggagcagcaaatcggccgctccggtgccaaccctggctttggcccccttggcatctacaagaagctcctcggcctcatcaagggcaagctgggcctcaccaagtgcaagtttgcctttgctggtgccgcgcccatgacccgtgagacccttcagtactttggcgcgctgaacatcaacattaacgaggtctacggcatgtccgagtgctccggtgccgccacctggtccacggacaaggcccacgagtggggcactgttggctacgagatgcccagttgcgaggtccgcgtcttcaagattgccgaggacggtaccaagaccgagtgcccgcgcgccgccgacattatgcatgctaccgaggaggagcagggcgaagtttgcttccgcggccgtaacatcatgatgggctaccttgccaaccccaagcttggcgacgaccacgttgccgagatcgaggagaagaacgctgccgctatcgactccgagggctggctccacagtggtgataagggcgccatttctacccgcggcatgctcaagatcacgggccgctacaaggagctcatcatcggcgccggtggcgagaacgtggcgcccgtccctattgaggacgccatcaaggcgcgcatgccttttgtttccaacgccatgatggtcggagataagcgcaagttcatggctgtcctccttaccctcaagacggttggcgccacgggcgagcttcccggtacgaacaagctcatgggcgctgccgccgactatggtgagaccatcgaggacgcctgcgacaacgaggcgctcattgaggagatcacgcagcagctcaaggagatcggtgatgatggcgatgtcacgccctcgaacgcggctcgcatccaaaagttcaccattctcccgctcgacttttccgtctccacggacgagctcacggccacgctcaagctcaagcgctccgtggtcgcagacaagtacgaagacatcatcgaggccttttacgagtccaagagcgtttttgtgccgtactcgaccgttggcgcctacgccacgggcggcccggtcgacgactccgttgtcgatggctccttcaagggcgactttagcatgattggcgacgatgatccggatcttcaaaacgtcgatgtcctcgaggcgattgacgaggacaattaaatttgagtagttagcttaatcacttaggtcaccggcctagtaggccggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatctgatcatggatgctacgtcacggcagtacaggactatcactagacctaggagctgtgctgggtaactcacatgagtcactggtcacatcagcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgttgcagcatacttggctaccaaaacccccaaatttaaccttattgtcagatgaagttcatctctggcgcattccccttgaccaaccagaatcacagctacaggatttagccgctaccttatctagtgacgaattagcccgtgcaaacagattttattttcccgaacatcgccggcgttttactgctggtcgtggtattctccgcagtatcttggggggctatttgggtgtggaaccagggcaagttaaatttgattatgaatcccgtggtaaaccaatattaggcgatcgctttgccgagagtggtttattatttaacttgtcacactcccagaacttggccttgtgtgcagtcaattacacgcgccaaatcggcatcgatttagaatatctccgccccacatctgatttagaatcccttgccaaaaggttctttttaccgcgagaatatgaattattgcgatcgctacccgatgagcaaaaacaaaaaattttctttcgttactggacttgtaaagaggcttatcttaaagcaacgggtgacggcatcgctaaattagaggaaattgaaatagcactaactcccacagaaccagctaagttacagacagctccagcgtggagtctcctagagctagtgccagatgataattgtgttgctgctgttgccgtggcgggttttggctggcagccaaaattctggcattattgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 51 - DNA, 46978 bp, Artificial sequence
  plasmid pDAB9330
gtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatctgatcatggatgctacgtcacggcagtacaggactatcactagacctaggagctgtgctgggtaactcacatgagtcactggtcacatcagcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 52 - DNA, 41726 bp, Artificial sequence
  plasmid pDAB9337
gtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 53 - DNA, 36797 bp, Artificial sequence
  plasmid pDAB9338
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagcttt

SEQ ID NO: 54 - DNA, 42674 bp, Artificial sequence
  plasmid pDAB9344
gtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaacttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 55 - DNA, 40406 bp, Artificial sequence
  plasmid pDAB9396
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatcactagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagcttt

SEQ ID NO: 56 - DNA, 39630 bp, Artificial sequence
  plasmid pDAB101412
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgaccaacttttctatacaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatcacgagtggatgactgtcacgactgactcatgactgactactagtgctagcctcgaggtcgacacaactttgtataataaagttgtctagacctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgatcatggatgctacgtcacggcagtacaggactatcactagacctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgacacccagcttt

SEQ ID NO: 57 - DNA, 36936 bp, Artificial sequence
  plasmid pDAB7733
gatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaagatgagtgatactcaggactcaggactcactctgctgatcactagtgctagcctcgaggtcgacacaactttgtatacaaaagttgtctagacctaggttaattaagcggccgcagcttatttctcttttcgatactctaattgagccgtgcgctctatctagaccaattagaattgatggagctctaaaggttgctggctgttttcttgttcatatgattaacttctaaacttgtgtataaatattctctgaaagtgcttcttttggcatatgtaggttgggcaaaaacgaggaagattgcttctcaatttggaagatgatgaacagccgaagaagaaaataagaataggcagtcctgctactcaatggatctcagtctataacggtcgtcgtcccatgaaacagaggtaacacattttttgcatatacactttgatagttcctcactaactgtgtaatcttttggtagatatcactacaatgttggagagacaaggctgcgccagcatatacagaagggaaatgaagatggccttttgattagctgtgtagcatcagcagctaatctctgggctctcatcatggatgctggaactggattcacttctcaagtttatgagttgtcaccggtcttcctacacaaggtaataatcagttgaagcaattaagaatcaatctgatttgtagtaaactaagaagaacttaccttatgatttccccgcaggactggattatggaacaatgggaaaagaactactatataagctccatagcgggttcagataacgggagctctttagttgttatgtcaaaaggttagtgtttagtgaataataaacttattatcaaaaagtcttcattgacttatttatatacttgttgtgaattggtaggaactacttattctcagcagtcatacaaagtgagtgactcatttccattcaagtggataaataagaaatggaaagaagattttcatgtaacctccatgacaactgctggtaatcgttggggtgtggtaatgtcgaggaactctggcttctctgatcaggtaggtttttgtctcttattgtctggtgtttttattttcccctgatagtctaatatgataaactctgcgttgtgaaaggtggtggagcttgactttttgtacccaagcgatgggatacataggaggtgggagaatgggtatagaataacatcaatggcagcaactgcggatcaagcagctttcatattaagcataccaaagcgtaagatggtggatgaaactcaagagactctccgcaccaccgcctttccaagtactcatgtcaaggttggtttctttagctttgaacacagatttggatctttttgttttgtttccatatacataggacctgagagcttttggttgaattttttttttttcaggacaaatgggcgaagaatctgtacattgcatcaatatgctatggcaggacagtgtgctgatgatacacacttaagcatcatgtgttgtgttagaaagccgaagacaattggagcgagcctcagggtcgtcataataccaatcaaagacgtaaaaccagacgcagtctctttggttgaatgtgatgaaagggatgtgtcttggtatgtatgtacgagtaacaaaagagaagatgcaattgagtagtagaaagatttgagagctttttaaagcccttcaagtgtgtgcttttatcttattgatatcatccatttgcgttgtttaatgcgtctttagatatgtttctgtttctttctcagtgtctgaatatctgataagtgcaatgtgagaaagccacaccaaaccaaaatattcaaatcttatatttttaataatgtcgaatcactcggagttgccaccttctgtgccaattgtgctgaatctatcacactaaaaaaaacatttcttcaaggtaatgacttgtggactatgttctgaattctcattaagtttttattttttgaagtttaagtttttaccttcttttttgaaaaatatcgttcataagatgtcacgccaggacatgagctacacatcacatattagcatgcagatgcggacgatttgtcactcacttcaaacacctaaaagagcttctctctcacagcacacacacatatgcatgcaatatttacacgtgatcgccatgcaaatctccattctcacctataaattagaggctcggcttcactttttactcaaaccaaaactcatcactacaagatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccattccaaacgaaatatcctcgagagtgtgtataccacggtgatatgagtgtggttgttgatgtatgttaacactacatagtcatggtgtgtgttccataaataatgtactaatgtaataagaactactccgtagacggtaataaaagagaagtttttttttttactcttgctactttcctataaagtgatgattaacaacagatacaccaaaaagaaaacaattaatctatattcacaatgaagcagtactagtctattgaacatgtcagattttctttttctagatgtctaatcaagccttcaaggctagtgataaaagatcatccaatgggatccaacaaagactcaaatctggttttgatcagatacttcgaaactatttttgtatgcactaaattatgcaagtgttcttttatttggtgaagactctttagaagcaaagaacgataagcagtaataaaaaaaataaagttcagttttaagatttgttattgacttagcggccgcttaattaaactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagtctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctag

SEQ ID NO: 58 - DNA, 36767 bp, Artificial sequence
  plasmid pDAB7734
gatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgaccaacttttctatacaaagttgtctagacctaggttaattaagcggccgcagcttatttctcttttcgatactctaattgagccgtgcgctctatctagaccaattagaattgatggagctctaaaggttgctggctgttttcttgttcatatgattaacttctaaacttgtgtataaatattctctgaaagtgcttcttttggcatatgtaggttgggcaaaaacgaggaagattgcttctcaatttggaagatgatgaacagccgaagaagaaaataagaataggcagtcctgctactcaatggatctcagtctataacggtcgtcgtcccatgaaacagaggtaacacattttttgcatatacactttgatagttcctcactaactgtgtaatcttttggtagatatcactacaatgttggagagacaaggctgcgccagcatatacagaagggaaatgaagatggccttttgattagctgtgtagcatcagcagctaatctctgggctctcatcatggatgctggaactggattcacttctcaagtttatgagttgtcaccggtcttcctacacaaggtaataatcagttgaagcaattaagaatcaatctgatttgtagtaaactaagaagaacttaccttatgatttccccgcaggactggattatggaacaatgggaaaagaactactatataagctccatagcgggttcagataacgggagctctttagttgttatgtcaaaaggttagtgtttagtgaataataaacttattatcaaaaagtcttcattgacttatttatatacttgttgtgaattggtaggaactacttattctcagcagtcatacaaagtgagtgactcatttccattcaagtggataaataagaaatggaaagaagattttcatgtaacctccatgacaactgctggtaatcgttggggtgtggtaatgtcgaggaactctggcttctctgatcaggtaggtttttgtctcttattgtctggtgtttttattttcccctgatagtctaatatgataaactctgcgttgtgaaaggtggtggagcttgactttttgtacccaagcgatgggatacataggaggtgggagaatgggtatagaataacatcaatggcagcaactgcggatcaagcagctttcatattaagcataccaaagcgtaagatggtggatgaaactcaagagactctccgcaccaccgcctttccaagtactcatgtcaaggttggtttctttagctttgaacacagatttggatctttttgttttgtttccatatacataggacctgagagcttttggttgaattttttttttttcaggacaaatgggcgaagaatctgtacattgcatcaatatgctatggcaggacagtgtgctgatgatacacacttaagcatcatgtgttgtgttagaaagccgaagacaattggagcgagcctcagggtcgtcataataccaatcaaagacgtaaaaccagacgcagtctctttggttgaatgtgatgaaagggatgtgtcttggtatgtatgtacgagtaacaaaagagaagatgcaattgagtagtagaaagatttgagagctttttaaagcccttcaagtgtgtgcttttatcttattgatatcatccatttgcgttgtttaatgcgtctttagatatgtttctgtttctttctcagtgtctgaatatctgataagtgcaatgtgagaaagccacaccaaaccaaaatattcaaatcttatatttttaataatgtcgaatcactcggagttgccaccttctgtgccaattgtgctgaatctatcacactaaaaaaaacatttcttcaaggtaatgacttgtggactatgttctgaattctcattaagtttttattttttgaagtttaagtttttaccttcttttttgaaaaatatcgttcataagatgtcacgccaggacatgagctacacatcacatattagcatgcagatgcggacgatttgtcactcacttcaaacacctaaaagagcttctctctcacagcacacacacatatgcatgcaatatttacacgtgatcgccatgcaaatctccattctcacctataaattagaggctcggcttcactttttactcaaaccaaaactcatcactacaagatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcaccattccaaacgaaatatcctcgagagtgtgtataccacggtgatatgagtgtggttgttgatgtatgttaacactacatagtcatggtgtgtgttccataaataatgtactaatgtaataagaactactccgtagacggtaataaaagagaagtttttttttttactcttgctactttcctataaagtgatgattaacaacagatacaccaaaaagaaaacaattaatctatattcacaatgaagcagtactagtctattgaacatgtcagattttctttttctagatgtctaatcaagccttcaaggctagtgataaaagatcatccaatgggatccaacaaagactcaaatctggttttgatcagatacttcgaaactatttttgtatgcactaaattatgcaagtgttcttttatttggtgaagactctttagaagcaaagaacgataagcagtaataaaaaaaataaagttcagttttaagatttgttattgacttagcggccgcttaattaaactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacg

SEQ ID NO: 59 - DNA, 35494 bp, Artificial sequence
  plasmid pDAB101493
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagtctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 60 - DNA, 37935 bp, Artificial sequence
  plasmid pDAB109507
gtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggttaattaagcggccgcagcttatttctcttttcgatactctaattgagccgtgcgctctatctagaccaattagaattgatggagctctaaaggttgctggctgttttcttgttcatatgattaacttctaaacttgtgtataaatattctctgaaagtgcttcttttggcatatgtaggttgggcaaaaacgaggaagattgcttctcaatttggaagatgatgaacagccgaagaagaaaataagaataggcagtcctgctactcaatggatctcagtctataacggtcgtcgtcccatgaaacagaggtaacacattttttgcatatacactttgatagttcctcactaactgtgtaatcttttggtagatatcactacaatgttggagagacaaggctgcgccagcatatacagaagggaaatgaagatggccttttgattagctgtgtagcatcagcagctaatctctgggctctcatcatggatgctggaactggattcacttctcaagtttatgagttgtcaccggtcttcctacacaaggtaataatcagttgaagcaattaagaatcaatctgatttgtagtaaactaagaagaacttaccttatgatttccccgcaggactggattatggaacaatgggaaaagaactactatataagctccatagcgggttcagataacgggagctctttagttgttatgtcaaaaggttagtgtttagtgaataataaacttattatcaaaaagtcttcattgacttatttatatacttgttgtgaattggtaggaactacttattctcagcagtcatacaaagtgagtgactcatttccattcaagtggataaataagaaatggaaagaagattttcatgtaacctccatgacaactgctggtaatcgttggggtgtggtaatgtcgaggaactctggcttctctgatcaggtaggtttttgtctcttattgtctggtgtttttattttcccctgatagtctaatatgataaactctgcgttgtgaaaggtggtggagcttgactttttgtacccaagcgatgggatacataggaggtgggagaatgggtatagaataacatcaatggcagcaactgcggatcaagcagctttcatattaagcataccaaagcgtaagatggtggatgaaactcaagagactctccgcaccaccgcctttccaagtactcatgtcaaggttggtttctttagctttgaacacagatttggatctttttgttttgtttccatatacataggacctgagagcttttggttgaattttttttttttcaggacaaatgggcgaagaatctgtacattgcatcaatatgctatggcaggacagtgtgctgatgatacacacttaagcatcatgtgttgtgttagaaagccgaagacaattggagcgagcctcagggtcgtcataataccaatcaaagacgtaaaaccagacgcagtctctttggttgaatgtgatgaaagggatgtgtcttggtatgtatgtacgagtaacaaaagagaagatgcaattgagtagtagaaagatttgagagctttttaaagcccttcaagtgtgtgcttttatcttattgatatcatccatttgcgttgtttaatgcgtctttagatatgtttctgtttctttctcagtgtctgaatatctgataagtgcaatgtgagaaagccacaccaaaccaaaatattcaaatcttatatttttaataatgtcgaatcactcggagttgccaccttctgtgccaattgtgctgaatctatcacactaaaaaaaacatttcttcaaggtaatgacttgtggactatgttctgaattctcattaagtttttattttttgaagtttaagtttttaccttcttttttgaaaaatatcgttcataagatgtcacgccaggacatgagctacacatcacatattagcatgcagatgcggacgatttgtcactcacttcaaacacctaaaagagcttctctctcacagcacacacacatatgcatgcaatatttacacgtgatcgccatgcaaatctccattctcacctataaattagaggctcggcttcactttttactcaaaccaaaactcatcactacaagatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccattccaaacgaaatatcctcgagagtgtgtataccacggtgatatgagtgtggttgttgatgtatgttaacactacatagtcatggtgtgtgttccataaataatgtactaatgtaataagaactactccgtagacggtaataaaagagaagtttttttttttactcttgctactttcctataaagtgatgattaacaacagatacaccaaaaagaaaacaattaatctatattcacaatgaagcagtactagtctattgaacatgtcagattttctttttctagatgtctaatcaagccttcaaggctagtgataaaagatcatccaatgggatccaacaaagactcaaatctggttttgatcagatacttcgaaactatttttgtatgcactaaattatgcaagtgttcttttatttggtgaagactctttagaagcaaagaacgataagcagtaataaaaaaaataaagttcagttttaagatttgttattgacttagcggccgcttaattaaactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagatctgattggtaagatatgggtactgtttggtttatatgttttgactattcagtcactatggcccccataaattttaattcggctggtatgtctcggttaagaccggtttgacatggttcatttcagttcaattatgttaatctggcacgtgatatgtttaccttcacacgaacattagtaatgatgggctaatttaagacttaacaggcctagagaggcccatcttattacgtaacggcgtcgtttagagtgcaccaagcttataaatgaaaacgagctacctcgggacatcacgctctttgtacactccgccatctctctctctcgttggagcagatctctctcgtgaatatcgacaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 61 - DNA, 38239 bp, Artificial sequence
  plasmid pDAB109508
gtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggttaattaagcggccgcagcttatttctcttttcgatactctaattgagccgtgcgctctatctagaccaattagaattgatggagctctaaaggttgctggctgttttcttgttcatatgattaacttctaaacttgtgtataaatattctctgaaagtgcttcttttggcatatgtaggttgggcaaaaacgaggaagattgcttctcaatttggaagatgatgaacagccgaagaagaaaataagaataggcagtcctgctactcaatggatctcagtctataacggtcgtcgtcccatgaaacagaggtaacacattttttgcatatacactttgatagttcctcactaactgtgtaatcttttggtagatatcactacaatgttggagagacaaggctgcgccagcatatacagaagggaaatgaagatggccttttgattagctgtgtagcatcagcagctaatctctgggctctcatcatggatgctggaactggattcacttctcaagtttatgagttgtcaccggtcttcctacacaaggtaataatcagttgaagcaattaagaatcaatctgatttgtagtaaactaagaagaacttaccttatgatttccccgcaggactggattatggaacaatgggaaaagaactactatataagctccatagcgggttcagataacgggagctctttagttgttatgtcaaaaggttagtgtttagtgaataataaacttattatcaaaaagtcttcattgacttatttatatacttgttgtgaattggtaggaactacttattctcagcagtcatacaaagtgagtgactcatttccattcaagtggataaataagaaatggaaagaagattttcatgtaacctccatgacaactgctggtaatcgttggggtgtggtaatgtcgaggaactctggcttctctgatcaggtaggtttttgtctcttattgtctggtgtttttattttcccctgatagtctaatatgataaactctgcgttgtgaaaggtggtggagcttgactttttgtacccaagcgatgggatacataggaggtgggagaatgggtatagaataacatcaatggcagcaactgcggatcaagcagctttcatattaagcataccaaagcgtaagatggtggatgaaactcaagagactctccgcaccaccgcctttccaagtactcatgtcaaggttggtttctttagctttgaacacagatttggatctttttgttttgtttccatatacataggacctgagagcttttggttgaattttttttttttcaggacaaatgggcgaagaatctgtacattgcatcaatatgctatggcaggacagtgtgctgatgatacacacttaagcatcatgtgttgtgttagaaagccgaagacaattggagcgagcctcagggtcgtcataataccaatcaaagacgtaaaaccagacgcagtctctttggttgaatgtgatgaaagggatgtgtcttggtatgtatgtacgagtaacaaaagagaagatgcaattgagtagtagaaagatttgagagctttttaaagcccttcaagtgtgtgcttttatcttattgatatcatccatttgcgttgtttaatgcgtctttagatatgtttctgtttctttctcagtgtctgaatatctgataagtgcaatgtgagaaagccacaccaaaccaaaatattcaaatcttatatttttaataatgtcgaatcactcggagttgccaccttctgtgccaattgtgctgaatctatcacactaaaaaaaacatttcttcaaggtaatgacttgtggactatgttctgaattctcattaagtttttattttttgaagtttaagtttttaccttcttttttgaaaaatatcgttcataagatgtcacgccaggacatgagctacacatcacatattagcatgcagatgcggacgatttgtcactcacttcaaacacctaaaagagcttctctctcacagcacacacacatatgcatgcaatatttacacgtgatcgccatgcaaatctccattctcacctataaattagaggctcggcttcactttttactcaaaccaaaactcatcactacaagatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccattccaaacgaaatatcctcgagagtgtgtataccacggtgatatgagtgtggttgttgatgtatgttaacactacatagtcatggtgtgtgttccataaataatgtactaatgtaataagaactactccgtagacggtaataaaagagaagtttttttttttactcttgctactttcctataaagtgatgattaacaacagatacaccaaaaagaaaacaattaatctatattcacaatgaagcagtactagtctattgaacatgtcagattttctttttctagatgtctaatcaagccttcaaggctagtgataaaagatcatccaatgggatccaacaaagactcaaatctggttttgatcagatacttcgaaactatttttgtatgcactaaattatgcaagtgttcttttatttggtgaagactctttagaagcaaagaacgataagcagtaataaaaaaaataaagttcagttttaagatttgttattgacttagcggccgcttaattaaactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 62 - DNA, 34850 bp, Artificial sequence
  plasmid pDAB109509
gtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagatctgattggtaagatatgggtactgtttggtttatatgttttgactattcagtcactatggcccccataaattttaattcggctggtatgtctcggttaagaccggtttgacatggttcatttcagttcaattatgttaatctggcacgtgatatgtttaccttcacacgaacattagtaatgatgggctaatttaagacttaacaggcctagagaggcccatcttattacgtaacggcgtcgtttagagtgcaccaagcttataaatgaaaacgagctacctcgggacatcacgctctttgtacactccgccatctctctctctcgttggagcagatctctctcgtgaatatcgacaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 63 - DNA, 35154 bp, Artificial sequence
  plasmid pDAB9151
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacaactttgtataataaagttgtctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 64 - DNA, 38074 bp, Artificial sequence
  plasmid pDAB108207
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcgaattcggcgcgccaaccttggactcccatgttggcaaaggcaaccaaacaaacaatgaatgatccgctcctgcatatggggcggtttgagtatttcaactgccatttgggctgaattgaagacatgctcctgtcagaaattccgtgatcttactcaatattcagtaatctcggccaatatcctaaatgtgcgtggctttatctgtctttgtattgtttcatcaattcatgtaacgtttgcttttcttatgaattttcaaataaattatcgatagtactacgaatatttcgtatcgctgatcttctcaatcacaatgatgcgtagtgacccgacaaataatttaagcgtccttaataccaatcctaaaataattgaggcaaataaaatttttttgtaatttttatgatagcagatcgattctccagcaagcctgcaacaaaatattgtgtatttctaaatagattttgatactcgaggtgaccgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactggtgacctaagtgattaagctaactactcagtaatgccagaacttgggctgccaaccaaaacccgcaacagccacagctgcaacacaattgtcatctggcacaagctccaacagagaccacgcaggagctgtttggagcttggcaggttctgttggggtgagtgctatctcgatctcttcaagtttggctattccatctcccgttgctttgagataagcctctttgcaagtccagtaacgaaagaaaatcttctgtttctgctcatcagggagtgacctcaagagttcatattctcttgggagaaagaacctctttgcaagagactccaagtcagatgttggacgcagatattcaagatcaatgcctatttgacgcgtgtagttgacagcacacaaggcaaggttctggctgtgagacaagttgaacaggagtccactctcagcaaatctgtcaccaaggatcggtttcccacgggactcataatcaaacttgacttgacccggttccactcccaagtatccacccaagatggatctgaggatgcctctcccagcagtgaaacgccttctgtgttctggaaagtagaatctgtttgccctcgccaattcatcactgctcagggtggcagcaaggtcttgaagttgtgactcaggctggtcaagaggaatcctccagagatgaacctcatctgacaagagggtcagattgggaggcttcggaagccaagtgtgctgaagcatttttggttgtggatcctagagtagtattgaatatgagttgggttggggtattatagtagtagagtagtagtactctggatggatggatgatgaaagaagtgagtgatattagaggtatttataggtattatataagagagaaggtggttggaacatgcatggagatttgggcatgggatgacacgcatatgcaggttgacgtgtgttgaagtgaagaaattgaggtggcggaagagaatgaatatatacaggtggttgtggtgatgatgaagaaaaaggcaatgtgtttgtgtgtgggttgagatgggtgagccatttaaagtgcatgttaagcacgtgttgctttgcatggcatttagacatacatggacgcggcgatcttgatcagccagtgactaatttgagttggttgtgtgattgcgttttgtctctctgttttgtcttttttctttgttctttgtctttttcttgcgcaagatccatgcatgaaccaaaagaccacagagtgtcatggcaacccacagtaattccagttacggacttacataccaagaaaaggtaaaagcaataagaaatatatgaaaattagtccaccataaatcttatagtttatggtttagggtaacactctaacactctactacattacttatatttactttaaactatctataaaacaatttaaacatagtagaataataaatcaatagtcacaaattcaacaattaaacttaaaattaaaaaagtaatattttaattatatctaattaattttttagaagtaatattgagtatttgatatatgaaatcttgaatatagtaactattattaaaattactttagaagatgtgtctcgcatgtaaaagcagatctaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtagcacatctgtactcactcaggtctagtggtcaggtcagattaattaagcggccgcgaattcggcgcgccaaccttggactcccatgttggcaaaggcaaccaaacaaacaatgaatgatccgctcctgcatatggggcggtttgagtatttcaactgccatttgggctgaattgaagacatgctcctgtcagaaattccgtgatcttactcaatattcagtaatctcggccaatatcctaaatgtgcgtggctttatctgtctttgtattgtttcatcaattcatgtaacgtttgcttttcttatgaattttcaaataaattatcgatagtactacgaatatttcgtatcgctgatcttctcaatcacaatgatgcgtagtgacccgacaaataatttaagcgtccttaataccaatcctaaaataattgaggcaaataaaatttttttgtaatttttatgatagcagatcgattctccagcaagcctgcaacaaaatattgtgtatttctaaatagattttgatactcgaggtcgacacaactttgtataataaagttgtctagacctagtagcacatctgtactcactcaggtctagtggtcaggtcagattaattaagcggccgcgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactggtgacctaagtgattaagctaactactcacagcttctcagcagggacatatgtgtcatcaatgctcgccacaagtgcagctgcaccatctgaaagccttgcatttctcagtatttcaagacgcctcaagaagcacgctcctctaagaatctgtttgttgatctgcacaacacacgggtactcatttgccactgccggatcaaggtaagttcctttgatgaaatcattgaatgaaccaatggcaggaccacaccaaacttggtagtccatgactctgtcagaagctccagtgttggcccaccttgaagccagggacagataccatctgaaacacagtgacatcttcagtttggggtccctctcagccctctgtatcttctctgggttgtggagacggttgatgtagaagttcttggtctcatcccagacctcttccaatgcacgactgaagattcttttctcaaccctcgcaagctctgctggaggcatggactcaaaagaatcatacttgcagaacaactcatagagtttgttggctcttgaagggaacattgttcctttcttcaaaacttgaagtttcacaccttcctcaaacatgtcagctgccggtgccatgcaaacatctgagtaagttgctttcgcaagctgtttcctcacattgtcacacgtcccagattgtttggcaacttggttcactgttccagtgacaatgaaagaggcacccatgttgaaagttgccagcgcagcttggggacacccaatgccacccccagcaccaacacgaaccctcaggtttgctgggtatccacactctctgtgaagcctatccctcaggttgataatcagaggcagaatgacatggattggacggttgtcagtgtgtccaccagaatcagcttcaaccgcaatgtcatcagccacaggaacacgtctggccaactcagcttgttcttgattgatctccccagaagcaatgagcttctgcaaaagatgctcaggtgcaggacgcatgaacatttcagccagctcagttctggagactttcccaatgattctgttccttatgttgactgacccatctgcattcctcgtcaacccagccgctctgtatctgacaacttgcggtgtcaacgtcatgaaggctgaagcctcaacaaaagtgacacccttttccaagaagagatcaacatttcccttctcaaggttgctgtcaaaaggagaatggatgaggttgacagcatatggtccattgggcagggcagcttgaatcttttcaatggactcacgcacaacttgcattggaaggcctccagcaccaaatgacgcaaggattccttgccttccagctgcgatcaccaagtccgcagaggcaattcccttggccattgcaccggtgtacagaggcgcagaaacaccataagttttcatgaaagctctgctgccaagatcagcaatgttgcacggagggacaatgacactggcatcagatggcgcagtctcaacaaggttgccagaagcacttgcagagctgagcgcaagcatggagtcaagatcaagcagggcactacgaagtgcatcagcactggcaacagcttttgtctccgcagctggggcagctttcttctgaactggagctgaaggagcaggagacggagatgaactgctggaagaggaactgctggaagagctggagctggaaggcgcattgtccttgttcaagatcggatctctggtctcatcttgctcatcaatgttgagacgcgcatagaatttcggagccacaggcttcatgatccttgaagagatggcagcttcaatcgcagggtccgcaggtgggaaggatgcaaggtctgctgaggagatggggtctgccttgctgttgaatctgccattcaactgaatctttctcacaaacttgtttttcttgggtttctcacctttacagagcgcagcataacaagcctcagcctctgcaacgagcttggagtggtagagcggactgatggtcactccaggaacaaggtgagccttcaatgaagccacgagcttgactattgtcgtccaagcatcctcgttctgcttgtctatggcaccagcaaggtggtttctctgtggtccaagcgtggttctcactgctgtgcttctgtgattgtttggcccaacttcaacaaacacatcatagttctgcttgtagatggtttcaactatctgagggaagttggcttgtttctcatagagctgtccagcatactccccaaaggatgaaggagcccattcatctttggcacccgtggctcttggcacaagcctcttctggtttatggtagtccagagatcaagaccatcaaccacagggaactcaaggttggcgtggatctttgcgatgtccttggtgtaaggtcccacctctgggcaatgcccacacatgccttgagtgactggaagcgcagggatgttgccaccaagacgagcaatcgcagctttgcatgcatcaggctttccactgatgagagcagtgttggcatcattgatgatggtcaacctcacatactttgagtctggtgctatggctgcttctatgtcttgtttcgttcccctcactatgtaaccttgccagaactcatcttttgggacagactgtggaatgccccaggcttctctgagcgcattgaactcaacagccagagctttgttccagacatctgactctctcaaatcctttgtcaactgatcgcttatcaaaccgtttttcttggagaaagcaaagatcatggaaatctctcccaaactgagtccaaaggctgctttgggcgtgatgttgagaacatctctcgccaggtttgtgaaggcaattgaggtgaggattccaagacggaacatttcaatcatgtttctgtcaaactcttgctgttgtgactcaagctcactcttgaagctggcccttggcatgacccatctgtcaccttcagcccagagacggtttgttttctcattgatgacctcatgaagttcaggccaaatcctatgaatgtcttgtgtgatgccatagtaagggctccttccttctccatacatgaaggcaactctgtcactggccaaaggctcaggcgcatatctgcttccagcaggggaactccaatcacgtctcatcttgagacatctcggaatgccttttgccgcaagttccacctctctctggagcttggatggagtggagaccaagctgagagcaaggggcttctgacttccagatgaagctgcatcttgggcaagggtctcaccaaggagttcaagaaagatcctacgggcttgcgccttcaattcagactctctgggtgcagcacccgtgggctgcaagaacctttcccttatcttgtccaatcttccaagaatctcttcatgggagtctgctctcaacacaatgagcttgggtgcttcctcatccaaactgattctgttctctctctcgtagtgtccctctgcttcagaaagcagcacactgtagcaacttctggtttcactgactccggaaacagccgcataacgtctctcaccagggttcttcaaccaagctcttgaggtctggcacgcaaagagtgtgctgtcccagggtgcttcaggtgcaggttcatcccagtcatctccattgctgggcaggtaacggttgtagatgcaaagcgcagccttaatcaaactggcagcaccagaagcataaccagtgtcaccaacagtggccttgacacttccagttgcaacattccttgggagcttgtcatcgtcacgaagaatcgtctgaagtccgccaatctcttcctcagcagtgagttcctttgggagaacagacgggtccttcaaatgcctcgctgaatcagcagaaagctccaacatctcgatgtctccaggcttgactctggcttgatccaatgcctctctcaaacatgcagatggaacatttccaggaactatggcatccatgcaagcatagattctgtcatccttggtgcagcttgtctcacgcttgagcacaaatgcaccacagccctctccaacaaagtaaccatcagcagctgcatcaaagctggctctcggggtgtcagatgtagacaccttgaaacgccttgacttgacgtaaaggttctcagcactcccacagagatcaacacccgcaaccacaaccccatcaacctctcccgtttccaagaggtatttgccaagttcagcacatctgtacacagaattgttgccttctgtgattgtgaaggaaggtcccgtgaagccccattgtgaactgacccttgttgcaaccaagttgcctatgtagctggtgtaagaagtgcttgtcccacaatcattgatgtactgcatcatgtcattgagtttcttgctggcttcaggcctcactctctccttgagagcaacccttgcacggtgacggtagagttcaagatcggtccccaaccccacaaagacagccacatttccacctttcttcatgccagagtccaatatggccctatcaattgtggtgacagccagaagctgttgaggcaagagcatatcttcaggagtcattggagtcctcagcctctggaaatcaacttcaacatcttcaatgtaacagccatgcggtgttgctttgactccacaaagatcaaggaagtccttgtctttccccaggaatctccatctcttttctgggagtggtatagcaccatgagcaccagtgtagatggccctttcaaaagcatccaatcctttcaaagcaccaaaagtggcatccatcccagtgattgctattctcatgtttgactcaccaccacaacgtgcagagagagcagaaatggagtcatggccagtgcatgcagcattgcttgggtcatgttcctcaaagacagcatgagcattggtcccaccaaatccaaacgctgagagaccagcacgcttcggttctccattcgtttctggccagggaatggcctcaccagagacaaccagagggtccatcttcgtttcgtcatctattcccggagtgggtggaatgatcccgtgcttcatggagagaagcactttgcacatgccagcaaacccagctgccaccaatgtgtgtccaaagttcccttttgtggttccaaaacgtgggactttgccttcaaagcaagccttcacagcatcaatttccacacgatcaccttgtggagtcccagttgcatggcattcaacatactgaatcttgtggggatgcacattgatacgtgtgtaggtgtccatgaggcactttttctctgacggcaaaaggggtttaagtggcagaccagtgccactgttgctgacattggctcccaaaagtgttccatagatgtgatctccatctctgattgcgtcatccaaacgtttgaggaccatgatggaacctccttcaccaggggtcaatccttgagaatctttgtgcagcggcatggacacattctgacccgttccaacaggcatggcttggaaggttgagaacccagagagtatgaaaaacggctccggcaggcatgttgcaccacaaagcatcacatcagctgcaccagagaccaagtgatcttgcgccagtctgagcacatagagcgcagtggcacaggcagcatcaacagagtagtggagagcgccaagattgagttcctcagcaacaaaggaagcagggtccatgaagattcttctgtcaccagcctctggtttgttggactgttctctttctgaccagtgagaggcatctttgaaaactctggcaccaagtttcttctcaacatggttctggtacacattcaagagttcaccttggaggttgtccatcgggaagctgaggcatccagaaactatgccacatcttgttgaatctttgacagatgtttcagccaaggcttgtttggcaaggttcaaaaggagttcatgctcattgtctatttcgttctcatcaagagttccatatgtctcattgcagaaggtgtcagcatacttgctcctttcagctttgtagtgttcagcacggtaatttgaaccaagacgtttgtcgctgatcactttgctctcaacttttccattcatgagaacttcccagaactcgtctttcgttttgcatccagcatactgaacagccatgcccacaacagctatcctcttctcgtcatgcatctcatgagccgcactcacgttccttgcagccatttttggttgtggatcctagagtagtattgaatatgagttgggttggggtattatagtagtagagtagtagtactctggatggatggatgatgaaagaagtgagtgatattagaggtatttataggtattatataagagagaaggtggttggaacatgcatggagatttgggcatgggatgacacgcatatgcaggttgacgtgtgttgaagtgaagaaattgaggtggcggaagagaatgaatatatacaggtggttgtggtgatgatgaagaaaaaggcaatgtgtttgtgtgtgggttgagatgggtgagccatttaaagtgcatgttaagcacgtgttgctttgcatggcatttagacatacatggacgcggcgatcttgatcagccagtgactaatttgagttggttgtgtgattgcgttttgtctctctgttttgtcttttttctttgttctttgtctttttcttgcgcaagatccatgcatgaaccaaaagaccacagagtgtcatggcaacccacagtaattccagttacggacttacataccaagaaaaggtaaaagcaataagaaatatatgaaaattagtccaccataaatcttatagtttatggtttagggtaacactctaacactctactacattacttatatttactttaaactatctataaaacaatttaaacatagtagaataataaatcaatagtcacaaattcaacaattaaacttaaaattaaaaaagtaatattttaattatatctaattaattttttagaagtaatattgagtatttgatatatgaaatcttgaatatagtaactattattaaaattactttagaagatgtgtctcgcatgtaaaagcagatctaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 65 - DNA, 36718 bp, Artificial sequence
  plasmid pDAB108208
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactactcagaacgcaagtgagtctgtcgcaatgacagaggcttgaacatcaatgaagagatcaccttgttcgttgtggaactgaagtgcatgtttgtgctggctatgtccaccactctgattggatctgagggtgatgtagaagggtttgtcttgtgggaccggtctgtgttggactatcctctgaatggagttcgggagtgcagcttgtcccagcgttctcctcacccagaccaacattgcttgaaaggcaagatcattgacaaagggatcatgtgcatcagtgtcagttgcaaactctcctctggctgcatctgatccaggaacagcagaacacttggcaacaagctggctcttggtgcagctgagaacgtcatcaatgcctctgaacgcaggaccatgaaagagagtcttgccatcatagactgacccttgcaaagcaggatctgcatcaaggctcggaggctgcatggttgcattggcaggtggagcaccttggttggacaacactatgacagctctgtaggctggaacaagttttccacttgagaacgtcttgagcgtcgcttggacattcaccctcccactcggagcagtggacggtgtgagggtcacttcacagttgacgtctccatcaacagtgacacctttgaagagctgtgcgtcatctatggcccagagagagtagccagggaagagtccaaggcaggtctcagcaaggctcccaatagcaagggtcattggcaacacccttctgccttgtatgacatgatcctccaagaagggattggacttggcactgatctttctatgcagggtgatcgtgtcacttccaactttcttggatggtgtcctccagtttccaacaaggatctcagcaggacttgatcccaacacaatcctcgcaactgtatcagcacctccttcacgaggaatgatctgaactcccatttcttgaaactgtttcttgagttgaggtgtcaccatcccaccatcccagggaccaaagcagatggacttgacactgacatccttcgcaagttccaaacccatcttgttgagagcttcgtttgccatcgcatagtcagactgaccaacattgccgtggaaaccagcaagggagctgaagagaaccatgtgtttgaggttggcacgatcaactgcagccagaagattctccaacccagtgactttggtcccaaagacagcatcaaactcgtcagggagtttcttctctatgagacgatcacggagcacaccagaagcgtgaacgattccactaactctggcaccaagctgggactctgcatccctaactgctttggcaacatctgcagcagagttcacatcacaagagctgtagatcgctttgccacccagagcttcaatggcagcaatggagcttctcacttcacgagcaccaagaacagatcccacaagtttcgtgacagcccttggagtgggtttgggtccttcaccagcactgaaggccctcttcaactcttgggtggcagctttctgcacagccttctcatcagtgatgccagcacaccatgctggttcagacgcagaaactttgctacgacccaacagaatgtacttgcctccagcaatctgacgcgtgatctcacggatgcaaagaggtgtgatcccacgagcacctccagaaaccagaagcacatcgtctttcgctatctgtctctgagggttcccagtctccaacttggcagctctgattgtgcatctttgctggtttgctccaatcccaacctctctgattctgatgtcagcacacgccatctccctaactatggcaactgcagcatcttctgggtgcatcccttgagcaatgtccacaccacggctgaacacatcagattctgaccactccaaccctattgtcttgcagagtccaaagatcgctccacgctgtgctctcttgagtgcgtcagaagtgccttgagaggtgaatccaagtctgccgtcaagcctagccacaccgatgaaggcaggacgacctccagccacagcagtgcagagagaggctttggcaaacttcgcacacatgagtgtgaaacccagtatctcagctggttcaaacctttctgcttgctggcttatgaagcctcccaacgctccaaatctttgctcagcctctttgatggccttctcagctgattctgctgaaaggtccttagccagaacatgacgaatggcagctgcaccagctctctgagccaactgcaatccctcaaaggtcaagacaactgcacaggctcccaacaccctcacaagagcaagtgtcaactctgagccatcgtcaacgacaagaactggacggttctccggtctttccagaatcagttcatctggccttctgatgtcaaccacctttgcgtgcatcagtgacaaatcgtcacagtcagcaccatgaactgaatcaatcttcacagctggtgcagcaccggcacttgcaggagcggctgcagccggagcaggggctgatccaccagctatctcagccttcatggcatcgaccacttctccaaccgttctggtccttgacaaagcatcgacatctttggcctcaacgttcagcatggcttgaacctcagaaaggatttccacacgcttgatgctatcaatcccaagctctgtttccaactccatgtctgactctatcatgtcagtctcgtatccagtctttgcagccaaaacctccatcacaacagtttcagctttttcaaggagttcgttgctgacagctggtgccgcggcagcgggagcaggagcggctgcagctggcgcaggagcagaacccccagctatctcagccttcatggcatcaaccacctctcccaccgtccttgttctggaaagagcatcaacatctttggcctccacattcaacatcgcttgaacctcagagaggatttcaacacgtttgatggagtcaattccaagctcggtctccagttccatgtcagattcaatcatgtcggtctcatagccagttttcgcagcaaggacttccatcacaactgtctcagccttttccaggagttctgaggagacggccggtgcggctgcagctggagccggtgccgcggctgcgggtgcaggagcggctgcagctggcgcaggcgcggaacttccagcgatctccgccttcatcgcatcaacgacctcaccaactgttctggtccttgagagggcatccacatccttagcctccacattgagcattgcttggacttcactgaggatctcaacacgcttgatgctgtcaatgcccaattccgtctcaagttccatgtcagactcaatcatgtcagtctcatagccggtttttgcagccagcacttccatgacaactgtttcagccttctcaagcaattcgttgctgacagctggtgccgcggctgcgggtgcaggtgcggcagctgccggcgcaggagcagagcctccagcaatctcagccttcatcgcatcgacaacttcccccacagttcttgtcctactgagtgcatcaacatctttagcctcaacgttgagcatggcttgcacctcagagaggatctccactctcttgatggaatctattccaagttcggtctccaattccatgtctgactcaatcatgtccgtttcgtaaccagtttttgcagcaaggacttccatcacaactgtttcggctttctccagcaactcattgctgacggcaggagcggctgcagctggagcaggtgccgcggcagcaggtgcaggtgcggctgcagctggcgcactagcagagcttccggcaatttcagccttcatggcgtccacgacctcaccgactgttctggttcttgaaagcgcatcgacatcttttgcctccacgttcaacatagcttggacctcagacaagatttcaacacgtttgatgctatctattcccaactcggtttcaagctccatgtcactttcaatcatgtcggtctcgtaaccagtcttagctgcgagcacctccatcacaaccgtctcggccttttccaggagttcggatgaaacagctggcgcgggcgcggccggtgctggtgcagctggagctggagctgcggctgccggtgcaggtgccgcggcagctggcgcaggcgcgctccctccagcaatctccgccttcatggcatccacaacctcacccactgtccttgttcttgaaagtgcatcaacatccttagcttcaacattgagcatggcttggacttcactcaggatctccactcttttgatggaatcgatcccaagctctgtctccaattccatatcagattcaatcatgtcggtctcatagccagtctttgcagccaaaacctccatcacaaccgtctcagccttctccaagagttctgaagaaacggcaggtgcaggtgcagctggagcaggtgccgcggctgcgggtgcaggagcggctgcagctggcgcgggcgcagaccctccagcaatttcagccttcatggcatccacaacctcaccaacggtcctcgttctggacagagcatcaacatccttcgcttccacgttcagcatagcttggacctcactgaggatttcaacacgtttgatgctgtctatcccaagttctgtctccaattccatgtcagactcaatcatgtcagtctcatagccggttttagctgccaagacctccatcacgacggtctcagctttttcaaggagttcgtttgagacggccggagcggctgcagctggagctggagccgcggcagcgggaccaggagcggcagcggccggcgcaggagcggagcctccagctatctcagccttcatggcattgacaacctcaccgacagttctggtccttgagagagcatccacatccttagcttccacattgagcatggcttggacttcactgaggatttccacacgcttgatggaatcaattccaagctccgtctcaagctccatgtctgattctatcatgtcagtttcgtagccagttttggcagcaaggacttccatcacaacagtttctgccttttcgagcagctcattagaaacagctggtgcagctgcagctggagccgctttagccggtgcaggtgcggcagctgccggcgccggagcggaagaaccagcgatttctgccttcatagcgttgacaacttcacccactgttctcgtcctagagagagcatcaacatctttcgcctcaacgttaagcatagcttggacttcagaaagaatttcaaccctcttgatgctgtcaattcccaactcagtctcaagctccatgtccgcctcaatcatgtctgtttcgtatccagtcttggcagcgagaacctccatcacaactgtctcagctttctcaagcaactcgttggacacggcgggagcaggagcacttgcaacgggagcggcaggggcagcggctttaacaggcgccggagcagtctgttgctgttgctgttgctgaagggaagaagcatcaacacttccataaccatccagctcagccagcatggacttgaggatggcacgatgtttctccacaacagcagtgtcaactgcaggcttggctgaagctgcagcagtcttggcttcctccttggcagcagcaagtttggagttggcttctgcagctgcacgtttggcgtcgtcaagctgcctctgagcgtcttgaagctccttctgaagcctttcagcctccctcttggcagcttcgtcaaccacaggttcaggagccttgatgagtggtgcagcacccttgaggtatgtgacacatcttccgtcgttcatggcagcatccctcactttcttggtcttgtcactgacataggtggcagctgaaagtctgagtgtggttctctttttcttgatggcttgcatcctcgtggcatcaggagcatcccacttgtcaaacccttgaagattgacaccagccacaaccagctgaactgcagcatccctcaactgtatgtcagagtccgtgccagaagctgggttcacagacactgtgacaacagacgggtcatctttgagggtttcagaaacaagtttgctgagaacttgtttcggtccaaactcaacaaagattctcgcaccagcttggtgcatgttcctcacttgggtcaggaacttcacagatgaggtcatgtgttgagtgagcatctctctggcatccgtcggataggtctctccagaaacattgctgaagagctttgtttctgctttgggtgtacggaaggaaaccttggatatgacatctttgaaagctgagctggcattttccatctgtggagaatggaaggcagactcacaagcaagaggcacaactctgaacccttccttctgcaatctggcactttcagcttgaatcccttcaacagacccagtaatgacagtctgagacggagagtttgagtttccaagccagacgttggcagcttgaaccttgatgttctctgcgttgggtcctatgacagctgccatgcaacctttgggtgtggcaggtgcatctttgcctcccatgatccttgcccttctgcaaacaagttcaaacaactcatctctgtcaacacaaccagctgcatagagcgcagcaaactcacccaagctgtgtccagctgcaaagtctggagtgaatccagcttccttgaaaatctcaaaggcaccaagagcacatgccagggttgacggctggctgtatgctgtgagtgagattttcttgtgatcttgttctggctcacgttcgtacggtttccttgggtacaggacttgagagactctttcaaagtctttgtcacttccagcaaccttggactgtgcagcgtccattgcagcaatggactgtctgaactgaggccagttcatcgcaacttcactgaacatgtgtgtgtactgagcaccttgtccagagaagagtgcagcaacagcaccattggtggcaatgcctttggcacggaaagaaactccttctctcggaagcctccacgcttctttggtcacatctttggcaaactgagcacatatagcacgaagcgtggagcacgcatcctccgcatctttgaccaagaatcccagtctcgcattggtcgcaggtatgctcccagggaacttgaactgttctccaaacttgacacacttgatgtaggcagtattcttgactgtctcattctccttgatcgcagcttcaaactctttcagctgagcttcacaaaggctctgcaacgcagcaggagttgcagccatcatcaacaccggttgtggacgtttgttgagtctgtacgctgtcgtgtgctctggttcagcctcttccaacactgcatggtagttggcacctccaaagccaaagctggatattccagcacgtctcggaacaccaggtggagggaaccagggtctgttcatcgtgttgatgtagagggatgactcattgatgggagtgttgtcatagagattgggtggattgtccacattgatcgttccaggcaaagtcttgtgtttgagagccatgatgaccttgatcattccagcaagaccagcaacagccttcaaatgaccaatactggacttgatacttccaactgcaactttctctgtgttcccttcaccatacgctttgtcaaacaagttcctcaacgcagtcaactcaatcctatctccaactggagtgccagtcccatgaccctcaaccaaagtgacagtggcagggtcaacgcaggcacgattgtatgcacgtctcaaggcttcctcttgaccactgattgtgggagtgtagatgccagctgctttgccatcacttgagcttgcacaaccacgaatcacagcatgaatctcatcaccatccctcactgcatctgcataacgtttgagcaccaacatggctgatccctcaccaatgagcatccctttcgttttctcatcatacgctctcacacttgggtccgtgctgaacacaggtgtctttgagaaagccatgtacatcccaatggagttgtctgtgcaggttgcaccagtgaccatcatgtcgcagtcaccatagagcagttcatcaatcgcaaccttgactgctatcaaggagcttgcacatgcagcatccacaacgcagttcatgccatccaagttgaatgtgttggtgcatctgccagcagtgacattcccaaggaatccagggaaagagtcaagtctccattctgggaagttcgctttgtacttctccacagccactttgacatcttcctctggcatccccatctttctcaagactttctccacaaccacatagttgagtctgctgtagaactcatgtgaactcttctgtccacctccaatgccaagcacgcatcctatgtttttcttctcctttccaagtgcatcaatcccagcatcttgaagtgcttctttgaccttgagaagtgagatggtctgattcgcatcagaatcttccatctggaacatgttgagaccaaactcacgcgcatcaaagtcatactcaggaatgaaacctcctctcttgcagtagattttgtcctttgtggtcttgactgggtcaaagtacgcagtcacatcaacacgatcctcaggaagatcagacaggcaatcaatgccagcccttatggtctcccatgactctctcaccgtggttccacaaggaagtatggcgctcatgcctatgatcgcaatcctcgtgtccatctcacctcctttctgctcttgcagcctcgctgccatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgaccaacttttctatacaaagttgtctagacctaggactaggcactgagtgactcactgacctgactgagtgactggcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactactcaaagcgcattcgttggctcatagacaaaggcagcatcttcagtctcaagatcaatcctcggatcatttctcagagcattaagacgcctcaggtaacatgcaccacgcaaaatctgaaggttgatctggacaacacatgggtactcattagagacagcaggatcaagatatgttcctttgatgaagtcattgaaggctccaatggctggaccacaccagacttgatagtccatgacacgatcaggagcacccatgttggcccaacgtgatgcaagaccaagataccatctgaaacacaaagacatcttgagtttggggtcatgttccgctctctgtatcttctctggattcttcaaaccattgatgtaaaagtccttggtctcttcccagacctcttgaagtgccctcttgaagatcctcttctcgatcctttcaagttcagcaggaggcattgaatcgaaagagtcgtacttgcaaaagagttcgtacaatttgttagctcttgatgggaacattgttcccttcttgagaacttggagtttcacaccttcctcaaacatatcagctgctggagccatgcaaatgtcactgtaggtggcttgactgagttgttttctcacgttgtcacatgtcccggactgtttagcaacttgattgacagtcccagtcactatgaaggcagctcccattgtgagggcagccgcagcagcttgtgggcagccaacaccgcctccagctccaactctgactctaaggtgcgcaggataaccacactctctgtgcagtctgttcctaaggttgatgatcaaaggcaagatgacgtggatgggacggttgtcagtgtgaccaccagaatcagcttcaacagcgatgtcgtctgcgacaggaacacgacgggcaagttcggcttgttcttgtgttatctcaccagaagctatgagtttctcaaggaggtgttccggagccggtctgatgaacatttcggcgagttctgttctggacacttttccaatgatacggtttctgatgttgacactcccatcagcgttccttgagagtccggctgcacggtaacgaacaacttggggagtgagggtcatgaatgcagaagcctccaccacagtaacgcccttttcgaggaagagatcaacattccccttttccaagttgctgtcaaaaggtgaatgaatgaggttcacagcatatggtccttgaggcagagccgcttgtatcttctccaaagctgccctcacatggtgcattggaagcccacccgctccaaaagaacccaatatcttcctcttcccagcagcaatgacaaggtccgcagacgcaattcccttggccattgctccagtgtacagaggtgctgacacattgtacgtttccatgaaggacttgtcaccaagatcacttatggagcatggtttgatactgacaatccttgaagaagttgcaggtttggattcaaactgcaccaaattggagttttcaacaccaagatacaatggattgtccacttcaagcaggacatctctcaactgagtcggactgagtgcaactccagttttcccagggtccgcttttgcgctgggtggctgttgttgaacatccggaatggcttgaggttttgcactgacaacacgaactctgagttctttggcttcatacacacggagaccatcaacccaaagtgctccatctgccactatgtcaacgtagcctccattttcaggagaggctgtgattgaaactatgtgcacctcacagtccatcgcacggttctttggtgtcaattgaccacggtacttccacgccgtttttccaggggcatgggcaaaggtcggattgctcacattgtattctcccggtatgttctggtccaccgcaaatgcctcaatgagctggaacattgactcaattcccaaagatccaggcatcacaggatcaaaccaaaagtgacaagagaagaaccagtcttgtgggttaacatctttgtgtccatgcgcatatcctttcccatgcagcccagaatcaggagcaatgttgaggtaatccaaatactcacactgttctgaccttctgagaacttgagcattagttgcatctggaagtttctcagtcagctgttctttgcctttggctgatgcgatttcaactcttctcacactcgtgttgttagttttgcaccaaggctccgtctttttcccattgtcaagtccagcttgctgagcaaacacctctggagtgaaccatccaaaggaagtgcttcctttgtagaaaaccacgccatcaacagacaactcaaacgtgaatctgtgaatccccatctttcccaacattgcatatccagtgcacttggtcacattccttatggttttccccctcacatccacatctggcctcaccatttcagcacttgcatcaaggttcctaaagagaatgtcatctttgtccatcgtcagtggtgctttcaacacactggtgagaacaccggatgtctgaagtccgatttccatgatgatggaataaggcatgtgcccatcattgcaagaaccatcaaagaaccacgcatcttgaggacagtcaaactcccccaccattgtgcctttgctgggattgcaatcaacattcaggaacttgccatgttccatgtttgtgacttcaacaactctagtcacaagagccaaatcaaaagcagggcttctgctcgtatttgacttatcaaatcttgcgaactctggtcccaagcagttgctaacttttccacacatgaactctgacatgttgtaccagttcagaggcatttctccagctttgcaattgttgtcaagtgggttgccagggaaagggatgaagcaaattgccctcggagggtaagaactaggggagaagaacggcgtcgggttgccaggaagttttgacatgggatgccaggacatttctttcggagcgagagcgtcacccttgaggatatgttcaggaagtgcaactggctttggcgcaagaacatctgctgagaaagcaggcttcgcaggggcagcagaagcactagcactggcaccagagctggccttggacgcttccggtcccacagtggctgcaccgttagcaaaaacgggctgaactttggaggggttcttgttcgtggatctcttctgcatcttgagagcaatgcccttgaagtccacgacgatctttttgttaagatccccctttccgtagtcgctgattctatcaaggctgaaatcttgacccttttcgaaatcaacgtcaatgatgttgacgtcagcaatggcgtacggatcgttatcctcgtcgaatcccatctctttgatctccatgacgtagaccaactttcccttatgaggagatatctgacccctacacctaactttgttcgggtgtccgttgacgggtctgaagtcaaatggtccggtggtaaggtgcaaaccgagccagatcatgtacatcttgagcatttgtgaacaaccgtcgctgacaagagatccagccatgacttgatccttaacaaaatggcatgggaagtaccaatggtccctctccaagattttctcaccaaccaactgacccaaaccgtacacacctcccttatggtcaatgctggtgactctatcaatcatgagcatcttacgtgcgcagagtttgtagttgatctccggcatgccattctttgagccaaaaacggaagcccaatctttgtcaaccaaggtctgcatctccttttcgttgagttttgttttgtgaaggcagggagcgacagcatagggagaaacatcttgctttggaatcttagctctggcagccaaatcccctcttgtgaacaccacaccctttcccgcatcaagctcctcatttgtgaagaagccagcacagccatctctcatctcaatgagaagcctcccattgacatagcagtcatactcaaagaagaacatggagatgccaccatccaaacgtttggcaaaaccggtcactctgatgtcatactcaagggtctctccctcatgggcaaccccatagaatgtcaacgtggtgttgagcagacggtaaactctgtcaccttggttctggaaatcaattcccatgtatgatatcagcatcaaatcgcactgtccactctcaaccagaactgcccagggacaatcacctccctcagacaattcgccattcactggaagatcatactcagtgaccattctggcaccaactctgtagttgttgacctcggcatccatgagtgtgacccttgtcacaagcaggtattcacgagcaggcagcctcacccttctggggtacttgtctatgacagcaaactccggaccaaaaaccttagctatgtcaccctctgcaaactccaggagttcctcatagttgaacacctcagttttgccagaggtcagttcctccttggtcatctcccaacatggcttcttgttggtcttgacacgaagcgccatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcttaattaatcacgagtggatgactgtcacgactgactcatgactgactactagtgctagcctcgaggtcgacacaactttgtataataaagttgtctagtctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 66 - DNA, 36517 bp, Artificial sequence
  plasmid pDAB108209
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactactcagaacgcaagtgagtctgtcgcaatgacagaggcttgaacatcaatgaagagatcaccttgttcgttgtggaactgaagtgcatgtttgtgctggctatgtccaccactctgattggatctgagggtgatgtagaagggtttgtcttgtgggaccggtctgtgttggactatcctctgaatggagttcgggagtgcagcttgtcccagcgttctcctcacccagaccaacattgcttgaaaggcaagatcattgacaaagggatcatgtgcatcagtgtcagttgcaaactctcctctggctgcatctgatccaggaacagcagaacacttggcaacaagctggctcttggtgcagctgagaacgtcatcaatgcctctgaacgcaggaccatgaaagagagtcttgccatcatagactgacccttgcaaagcaggatctgcatcaaggctcggaggctgcatggttgcattggcaggtggagcaccttggttggacaacactatgacagctctgtaggctggaacaagttttccacttgagaacgtcttgagcgtcgcttggacattcaccctcccactcggagcagtggacggtgtgagggtcacttcacagttgacgtctccatcaacagtgacacctttgaagagctgtgcgtcatctatggcccagagagagtagccagggaagagtccaaggcaggtctcagcaaggctcccaatagcaagggtcattggcaacacccttctgccttgtatgacatgatcctccaagaagggattggacttggcactgatctttctatgcagggtgatcgtgtcacttccaactttcttggatggtgtcctccagtttccaacaaggatctcagcaggacttgatcccaacacaatcctcgcaactgtatcagcacctccttcacgaggaatgatctgaactcccatttcttgaaactgtttcttgagttgaggtgtcaccatcccaccatcccagggaccaaagcagatggacttgacactgacatccttcgcaagttccaaacccatcttgttgagagcttcgtttgccatcgcatagtcagactgaccaacattgccgtggaaaccagcaagggagctgaagagaaccatgtgtttgaggttggcacgatcaactgcagccagaagattctccaacccagtgactttggtcccaaagacagcatcaaactcgtcagggagtttcttctctatgagacgatcacggagcacaccagaagcgtgaacgattccactaactctggcaccaagctgggactctgcatccctaactgctttggcaacatctgcagcagagttcacatcacaagagctgtagatcgctttgccacccagagcttcaatggcagcaatggagcttctcacttcacgagcaccaagaacagatcccacaagtttcgtgacagcccttggagtgggtttgggtccttcaccagcactgaaggccctcttcaactcttgggtggcagctttctgcacagccttctcatcagtgatgccagcacaccatgctggttcagacgcagaaactttgctacgacccaacagaatgtacttgcctccagcaatctgacgcgtgatctcacggatgcaaagaggtgtgatcccacgagcacctccagaaaccagaagcacatcgtctttcgctatctgtctctgagggttcccagtctccaacttggcagctctgattgtgcatctttgctggtttgctccaatcccaacctctctgattctgatgtcagcacacgccatctccctaactatggcaactgcagcatcttctgggtgcatcccttgagcaatgtccacaccacggctgaacacatcagattctgaccactccaaccctattgtcttgcagagtccaaagatcgctccacgctgtgctctcttgagtgcgtcagaagtgccttgagaggtgaatccaagtctgccgtcaagcctagccacaccgatgaaggcaggacgacctccagccacagcagtgcagagagaggctttggcaaacttcgcacacatgagtgtgaaacccagtatctcagctggttcaaacctttctgcttgctggcttatgaagcctcccaacgctccaaatctttgctcagcctctttgatggccttctcagctgattctgctgaaaggtccttagccagaacatgacgaatggcagctgcaccagctctctgagccaactgcaatccctcaaaggtcaagacaactgcacaggctcccaacaccctcacaagagcaagtgtcaactctgagccatcgtcaacgacaagaactggacggttctccggtctttccagaatcagttcatctggccttctgatgtcaaccacctttgcgtgcatcagtgacaaatcgtcacagtcagcaccatgaactgaatcaatcttcacagctggtgcagcaccggcacttgcaggagcggctgcagccggagcaggggctgatccaccagctatctcagccttcatggcatcgaccacttctccaaccgttctggtccttgacaaagcatcgacatctttggcctcaacgttcagcatggcttgaacctcagaaaggatttccacacgcttgatgctatcaatcccaagctctgtttccaactccatgtctgactctatcatgtcagtctcgtatccagtctttgcagccaaaacctccatcacaacagtttcagctttttcaaggagttcgttgctgacagctggtgccgcggcagcgggagcaggagcggctgcagctggcgcaggagcagaacccccagctatctcagccttcatggcatcaaccacctctcccaccgtccttgttctggaaagagcatcaacatctttggcctccacattcaacatcgcttgaacctcagagaggatttcaacacgtttgatggagtcaattccaagctcggtctccagttccatgtcagattcaatcatgtcggtctcatagccagttttcgcagcaaggacttccatcacaactgtctcagccttttccaggagttctgaggagacggccggtgcggctgcagctggagccggtgccgcggctgcgggtgcaggagcggctgcagctggcgcaggcgcggaacttccagcgatctccgccttcatcgcatcaacgacctcaccaactgttctggtccttgagagggcatccacatccttagcctccacattgagcattgcttggacttcactgaggatctcaacacgcttgatgctgtcaatgcccaattccgtctcaagttccatgtcagactcaatcatgtcagtctcatagccggtttttgcagccagcacttccatgacaactgtttcagccttctcaagcaattcgttgctgacagctggtgccgcggctgcgggtgcaggtgcggcagctgccggcgcaggagcagagcctccagcaatctcagccttcatcgcatcgacaacttcccccacagttcttgtcctactgagtgcatcaacatctttagcctcaacgttgagcatggcttgcacctcagagaggatctccactctcttgatggaatctattccaagttcggtctccaattccatgtctgactcaatcatgtccgtttcgtaaccagtttttgcagcaaggacttccatcacaactgtttcggctttctccagcaactcattgctgacggcaggagcggctgcagctggagcaggtgccgcggcagcaggtgcaggtgcggctgcagctggcgcactagcagagcttccggcaatttcagccttcatggcgtccacgacctcaccgactgttctggttcttgaaagcgcatcgacatcttttgcctccacgttcaacatagcttggacctcagacaagatttcaacacgtttgatgctatctattcccaactcggtttcaagctccatgtcactttcaatcatgtcggtctcgtaaccagtcttagctgcgagcacctccatcacaaccgtctcggccttttccaggagttcggatgaaacagctggcgcgggcgcggccggtgctggtgcagctggagctggagctgcggctgccggtgcaggtgccgcggcagctggcgcaggcgcgctccctccagcaatctccgccttcatggcatccacaacctcacccactgtccttgttcttgaaagtgcatcaacatccttagcttcaacattgagcatggcttggacttcactcaggatctccactcttttgatggaatcgatcccaagctctgtctccaattccatatcagattcaatcatgtcggtctcatagccagtctttgcagccaaaacctccatcacaaccgtctcagccttctccaagagttctgaagaaacggcaggtgcaggtgcagctggagcaggtgccgcggctgcgggtgcaggagcggctgcagctggcgcgggcgcagaccctccagcaatttcagccttcatggcatccacaacctcaccaacggtcctcgttctggacagagcatcaacatccttcgcttccacgttcagcatagcttggacctcactgaggatttcaacacgtttgatgctgtctatcccaagttctgtctccaattccatgtcagactcaatcatgtcagtctcatagccggttttagctgccaagacctccatcacgacggtctcagctttttcaaggagttcgtttgagacggccggagcggctgcagctggagctggagccgcggcagcgggaccaggagcggcagcggccggcgcaggagcggagcctccagctatctcagccttcatggcattgacaacctcaccgacagttctggtccttgagagagcatccacatccttagcttccacattgagcatggcttggacttcactgaggatttccacacgcttgatggaatcaattccaagctccgtctcaagctccatgtctgattctatcatgtcagtttcgtagccagttttggcagcaaggacttccatcacaacagtttctgccttttcgagcagctcattagaaacagctggtgcagctgcagctggagccgctttagccggtgcaggtgcggcagctgccggcgccggagcggaagaaccagcgatttctgccttcatagcgttgacaacttcacccactgttctcgtcctagagagagcatcaacatctttcgcctcaacgttaagcatagcttggacttcagaaagaatttcaaccctcttgatgctgtcaattcccaactcagtctcaagctccatgtccgcctcaatcatgtctgtttcgtatccagtcttggcagcgagaacctccatcacaactgtctcagctttctcaagcaactcgttggacacggcgggagcaggagcacttgcaacgggagcggcaggggcagcggctttaacaggcgccggagcagtctgttgctgttgctgttgctgaagggaagaagcatcaacacttccataaccatccagctcagccagcatggacttgaggatggcacgatgtttctccacaacagcagtgtcaactgcaggcttggctgaagctgcagcagtcttggcttcctccttggcagcagcaagtttggagttggcttctgcagctgcacgtttggcgtcgtcaagctgcctctgagcgtcttgaagctccttctgaagcctttcagcctccctcttggcagcttcgtcaaccacaggttcaggagccttgatgagtggtgcagcacccttgaggtatgtgacacatcttccgtcgttcatggcagcatccctcactttcttggtcttgtcactgacataggtggcagctgaaagtctgagtgtggttctctttttcttgatggcttgcatcctcgtggcatcaggagcatcccacttgtcaaacccttgaagattgacaccagccacaaccagctgaactgcagcatccctcaactgtatgtcagagtccgtgccagaagctgggttcacagacactgtgacaacagacgggtcatctttgagggtttcagaaacaagtttgctgagaacttgtttcggtccaaactcaacaaagattctcgcaccagcttggtgcatgttcctcacttgggtcaggaacttcacagatgaggtcatgtgttgagtgagcatctctctggcatccgtcggataggtctctccagaaacattgctgaagagctttgtttctgctttgggtgtacggaaggaaaccttggatatgacatctttgaaagctgagctggcattttccatctgtggagaatggaaggcagactcacaagcaagaggcacaactctgaacccttccttctgcaatctggcactttcagcttgaatcccttcaacagacccagtaatgacagtctgagacggagagtttgagtttccaagccagacgttggcagcttgaaccttgatgttctctgcgttgggtcctatgacagctgccatgcaacctttgggtgtggcaggtgcatctttgcctcccatgatccttgcccttctgcaaacaagttcaaacaactcatctctgtcaacacaaccagctgcatagagcgcagcaaactcacccaagctgtgtccagctgcaaagtctggagtgaatccagcttccttgaaaatctcaaaggcaccaagagcacatgccagggttgacggctggctgtatgctgtgagtgagattttcttgtgatcttgttctggctcacgttcgtacggtttccttgggtacaggacttgagagactctttcaaagtctttgtcacttccagcaaccttggactgtgcagcgtccattgcagcaatggactgtctgaactgaggccagttcatcgcaacttcactgaacatgtgtgtgtactgagcaccttgtccagagaagagtgcagcaacagcaccattggtggcaatgcctttggcacggaaagaaactccttctctcggaagcctccacgcttctttggtcacatctttggcaaactgagcacatatagcacgaagcgtggagcacgcatcctccgcatctttgaccaagaatcccagtctcgcattggtcgcaggtatgctcccagggaacttgaactgttctccaaacttgacacacttgatgtaggcagtattcttgactgtctcattctccttgatcgcagcttcaaactctttcagctgagcttcacaaaggctctgcaacgcagcaggagttgcagccatcatcaacaccggttgtggacgtttgttgagtctgtacgctgtcgtgtgctctggttcagcctcttccaacactgcatggtagttggcacctccaaagccaaagctggatattccagcacgtctcggaacaccaggtggagggaaccagggtctgttcatcgtgttgatgtagagggatgactcattgatgggagtgttgtcatagagattgggtggattgtccacattgatcgttccaggcaaagtcttgtgtttgagagccatgatgaccttgatcattccagcaagaccagcaacagccttcaaatgaccaatactggacttgatacttccaactgcaactttctctgtgttcccttcaccatacgctttgtcaaacaagttcctcaacgcagtcaactcaatcctatctccaactggagtgccagtcccatgaccctcaaccaaagtgacagtggcagggtcaacgcaggcacgattgtatgcacgtctcaaggcttcctcttgaccactgattgtgggagtgtagatgccagctgctttgccatcacttgagcttgcacaaccacgaatcacagcatgaatctcatcaccatccctcactgcatctgcataacgtttgagcaccaacatggctgatccctcaccaatgagcatccctttcgttttctcatcatacgctctcacacttgggtccgtgctgaacacaggtgtctttgagaaagccatgtacatcccaatggagttgtctgtgcaggttgcaccagtgaccatcatgtcgcagtcaccatagagcagttcatcaatcgcaaccttgactgctatcaaggagcttgcacatgcagcatccacaacgcagttcatgccatccaagttgaatgtgttggtgcatctgccagcagtgacattcccaaggaatccagggaaagagtcaagtctccattctgggaagttcgctttgtacttctccacagccactttgacatcttcctctggcatccccatctttctcaagactttctccacaaccacatagttgagtctgctgtagaactcatgtgaactcttctgtccacctccaatgccaagcacgcatcctatgtttttcttctcctttccaagtgcatcaatcccagcatcttgaagtgcttctttgaccttgagaagtgagatggtctgattcgcatcagaatcttccatctggaacatgttgagaccaaactcacgcgcatcaaagtcatactcaggaatgaaacctcctctcttgcagtagattttgtcctttgtggtcttgactgggtcaaagtacgcagtcacatcaacacgatcctcaggaagatcagacaggcaatcaatgccagcccttatggtctcccatgactctctcaccgtggttccacaaggaagtatggcgctcatgcctatgatcgcaatcctcgtgtccatctcacctcctttctgctcttgcagcctcgctgccatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagaaccggtgactactctacagccttggattaggcacggcatcgcgatctcttgggccgttgacttttaacttgcgatgacttttctaatttacgagtcaataaccattctccctcagatattgacttgttcgtagataagtgtcactttggaagctagcattacgagtacacgggtcggcaacttgcaaatcgtcgaaaattgctatgcaagttgatctctgatttggtagtacactcagctttgtgatcagccaatactcattacgtggtttattagcaaaatgaatcgacatgagccacagcgagtgacaccagttacgattccctcacaacctccgtctcgtgaaacgtaatagatcagcgttgtatgatgtaagatattgtagttttggatgtcaacgtagggtcgtgaagaggtttattaactcacatgttggaacccttagtgagttttcactttacaaatcacgcgtgccactacgtattacttcatcgtagatagggacaacacagaaacgaaagtgcgaaacctttacatcaccaggtcccaggcgagattcccaggggtgactaaaagtacgcatttgaaaactatgggggctattgaatctaaacatcagatagtcaccatgatcaatatccccgttacgcttgcttcgtaatctgggggagtagccgcttcccgcgcttacgagcgtgctcaagggccatacaaactgaccccagtgagccgttcagagtgcgtgccattgagaattggcgtacttctgttgaaaaaagtgcgataacgctcttcagggtggtcgataacccaagcgtagaatcacactttgcagaggatatgaggttcttaactaggatacttggggcgatcatcaagtaaggatgaagtcgcgtacgtactttctacatgctcagctaaagtgcaagcgggggacatgacgagatgattccaggaatcggggacattggcttagggcttatagatgtcttgttcgataacaccggtggatccccgggtaccgagctcgaattcctcgaccaacttttctatacaaagttgtctagacctaggactaggcactgagtgactcactgacctgactgagtgactggcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactactcaaagcgcattcgttggctcatagacaaaggcagcatcttcagtctcaagatcaatcctcggatcatttctcagagcattaagacgcctcaggtaacatgcaccacgcaaaatctgaaggttgatctggacaacacatgggtactcattagagacagcaggatcaagatatgttcctttgatgaagtcattgaaggctccaatggctggaccacaccagacttgatagtccatgacacgatcaggagcacccatgttggcccaacgtgatgcaagaccaagataccatctgaaacacaaagacatcttgagtttggggtcatgttccgctctctgtatcttctctggattcttcaaaccattgatgtaaaagtccttggtctcttcccagacctcttgaagtgccctcttgaagatcctcttctcgatcctttcaagttcagcaggaggcattgaatcgaaagagtcgtacttgcaaaagagttcgtacaatttgttagctcttgatgggaacattgttcccttcttgagaacttggagtttcacaccttcctcaaacatatcagctgctggagccatgcaaatgtcactgtaggtggcttgactgagttgttttctcacgttgtcacatgtcccggactgtttagcaacttgattgacagtcccagtcactatgaaggcagctcccattgtgagggcagccgcagcagcttgtgggcagccaacaccgcctccagctccaactctgactctaaggtgcgcaggataaccacactctctgtgcagtctgttcctaaggttgatgatcaaaggcaagatgacgtggatgggacggttgtcagtgtgaccaccagaatcagcttcaacagcgatgtcgtctgcgacaggaacacgacgggcaagttcggcttgttcttgtgttatctcaccagaagctatgagtttctcaaggaggtgttccggagccggtctgatgaacatttcggcgagttctgttctggacacttttccaatgatacggtttctgatgttgacactcccatcagcgttccttgagagtccggctgcacggtaacgaacaacttggggagtgagggtcatgaatgcagaagcctccaccacagtaacgcccttttcgaggaagagatcaacattccccttttccaagttgctgtcaaaaggtgaatgaatgaggttcacagcatatggtccttgaggcagagccgcttgtatcttctccaaagctgccctcacatggtgcattggaagcccacccgctccaaaagaacccaatatcttcctcttcccagcagcaatgacaaggtccgcagacgcaattcccttggccattgctccagtgtacagaggtgctgacacattgtacgtttccatgaaggacttgtcaccaagatcacttatggagcatggtttgatactgacaatccttgaagaagttgcaggtttggattcaaactgcaccaaattggagttttcaacaccaagatacaatggattgtccacttcaagcaggacatctctcaactgagtcggactgagtgcaactccagttttcccagggtccgcttttgcgctgggtggctgttgttgaacatccggaatggcttgaggttttgcactgacaacacgaactctgagttctttggcttcatacacacggagaccatcaacccaaagtgctccatctgccactatgtcaacgtagcctccattttcaggagaggctgtgattgaaactatgtgcacctcacagtccatcgcacggttctttggtgtcaattgaccacggtacttccacgccgtttttccaggggcatgggcaaaggtcggattgctcacattgtattctcccggtatgttctggtccaccgcaaatgcctcaatgagctggaacattgactcaattcccaaagatccaggcatcacaggatcaaaccaaaagtgacaagagaagaaccagtcttgtgggttaacatctttgtgtccatgcgcatatcctttcccatgcagcccagaatcaggagcaatgttgaggtaatccaaatactcacactgttctgaccttctgagaacttgagcattagttgcatctggaagtttctcagtcagctgttctttgcctttggctgatgcgatttcaactcttctcacactcgtgttgttagttttgcaccaaggctccgtctttttcccattgtcaagtccagcttgctgagcaaacacctctggagtgaaccatccaaaggaagtgcttcctttgtagaaaaccacgccatcaacagacaactcaaacgtgaatctgtgaatccccatctttcccaacattgcatatccagtgcacttggtcacattccttatggttttccccctcacatccacatctggcctcaccatttcagcacttgcatcaaggttcctaaagagaatgtcatctttgtccatcgtcagtggtgctttcaacacactggtgagaacaccggatgtctgaagtccgatttccatgatgatggaataaggcatgtgcccatcattgcaagaaccatcaaagaaccacgcatcttgaggacagtcaaactcccccaccattgtgcctttgctgggattgcaatcaacattcaggaacttgccatgttccatgtttgtgacttcaacaactctagtcacaagagccaaatcaaaagcagggcttctgctcgtatttgacttatcaaatcttgcgaactctggtcccaagcagttgctaacttttccacacatgaactctgacatgttgtaccagttcagaggcatttctccagctttgcaattgttgtcaagtgggttgccagggaaagggatgaagcaaattgccctcggagggtaagaactaggggagaagaacggcgtcgggttgccaggaagttttgacatgggatgccaggacatttctttcggagcgagagcgtcacccttgaggatatgttcaggaagtgcaactggctttggcgcaagaacatctgctgagaaagcaggcttcgcaggggcagcagaagcactagcactggcaccagagctggccttggacgcttccggtcccacagtggctgcaccgttagcaaaaacgggctgaactttggaggggttcttgttcgtggatctcttctgcatcttgagagcaatgcccttgaagtccacgacgatctttttgttaagatccccctttccgtagtcgctgattctatcaaggctgaaatcttgacccttttcgaaatcaacgtcaatgatgttgacgtcagcaatggcgtacggatcgttatcctcgtcgaatcccatctctttgatctccatgacgtagaccaactttcccttatgaggagatatctgacccctacacctaactttgttcgggtgtccgttgacgggtctgaagtcaaatggtccggtggtaaggtgcaaaccgagccagatcatgtacatcttgagcatttgtgaacaaccgtcgctgacaagagatccagccatgacttgatccttaacaaaatggcatgggaagtaccaatggtccctctccaagattttctcaccaaccaactgacccaaaccgtacacacctcccttatggtcaatgctggtgactctatcaatcatgagcatcttacgtgcgcagagtttgtagttgatctccggcatgccattctttgagccaaaaacggaagcccaatctttgtcaaccaaggtctgcatctccttttcgttgagttttgttttgtgaaggcagggagcgacagcatagggagaaacatcttgctttggaatcttagctctggcagccaaatcccctcttgtgaacaccacaccctttcccgcatcaagctcctcatttgtgaagaagccagcacagccatctctcatctcaatgagaagcctcccattgacatagcagtcatactcaaagaagaacatggagatgccaccatccaaacgtttggcaaaaccggtcactctgatgtcatactcaagggtctctccctcatgggcaaccccatagaatgtcaacgtggtgttgagcagacggtaaactctgtcaccttggttctggaaatcaattcccatgtatgatatcagcatcaaatcgcactgtccactctcaaccagaactgcccagggacaatcacctccctcagacaattcgccattcactggaagatcatactcagtgaccattctggcaccaactctgtagttgttgacctcggcatccatgagtgtgacccttgtcacaagcaggtattcacgagcaggcagcctcacccttctggggtacttgtctatgacagcaaactccggaccaaaaaccttagctatgtcaccctctgcaaactccaggagttcctcatagttgaacacctcagttttgccagaggtcagttcctccttggtcatctcccaacatggcttcttgttggtcttgacacgaagcgccatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcttaattaatcacgagtggatgactgtcacgactgactcatgactgactactagtgctagcctcgaggtcgacacaactttgtataataaagttgtctagtctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 67 - DNA, 36590 bp, Artificial sequence
  plasmid pDAB9159
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacctttaaacggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctcggccggccttggccacggtggccagatccactagaggcgcgcctctagtgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctttaaacggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctcggccggccttggccacggtggccagatccactagaggcgcgcctctagtgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacctttaaacggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctcggccggccttggccacggtggccagatccactagaggcgcgcctctagtgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctttaaacggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctcggccggccttggccacggtggccagatccactagaggcgcgcctctagtgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 68 - DNA, 35499 bp, Artificial sequence
  plasmid pDAB9147
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctgtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 69 - DNA, 22042 bp, Artificial sequence
  plasmid pDAB108224
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagtgatcagcagagtgagtcctgagtcctgagtatcactcatcttaattaagcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactactcagaacgcaagtgagtctgtcgcaatgacagaggcttgaacatcaatgaagagatcaccttgttcgttgtggaactgaagtgcatgtttgtgctggctatgtccaccactctgattggatctgagggtgatgtagaagggtttgtcttgtgggaccggtctgtgttggactatcctctgaatggagttcgggagtgcagcttgtcccagcgttctcctcacccagaccaacattgcttgaaaggcaagatcattgacaaagggatcatgtgcatcagtgtcagttgcaaactctcctctggctgcatctgatccaggaacagcagaacacttggcaacaagctggctcttggtgcagctgagaacgtcatcaatgcctctgaacgcaggaccatgaaagagagtcttgccatcatagactgacccttgcaaagcaggatctgcatcaaggctcggaggctgcatggttgcattggcaggtggagcaccttggttggacaacactatgacagctctgtaggctggaacaagttttccacttgagaacgtcttgagcgtcgcttggacattcaccctcccactcggagcagtggacggtgtgagggtcacttcacagttgacgtctccatcaacagtgacacctttgaagagctgtgcgtcatctatggcccagagagagtagccagggaagagtccaaggcaggtctcagcaaggctcccaatagcaagggtcattggcaacacccttctgccttgtatgacatgatcctccaagaagggattggacttggcactgatctttctatgcagggtgatcgtgtcacttccaactttcttggatggtgtcctccagtttccaacaaggatctcagcaggacttgatcccaacacaatcctcgcaactgtatcagcacctccttcacgaggaatgatctgaactcccatttcttgaaactgtttcttgagttgaggtgtcaccatcccaccatcccagggaccaaagcagatggacttgacactgacatccttcgcaagttccaaacccatcttgttgagagcttcgtttgccatcgcatagtcagactgaccaacattgccgtggaaaccagcaagggagctgaagagaaccatgtgtttgaggttggcacgatcaactgcagccagaagattctccaacccagtgactttggtcccaaagacagcatcaaactcgtcagggagtttcttctctatgagacgatcacggagcacaccagaagcgtgaacgattccactaactctggcaccaagctgggactctgcatccctaactgctttggcaacatctgcagcagagttcacatcacaagagctgtagatcgctttgccacccagagcttcaatggcagcaatggagcttctcacttcacgagcaccaagaacagatcccacaagtttcgtgacagcccttggagtgggtttgggtccttcaccagcactgaaggccctcttcaactcttgggtggcagctttctgcacagccttctcatcagtgatgccagcacaccatgctggttcagacgcagaaactttgctacgacccaacagaatgtacttgcctccagcaatctgacgcgtgatctcacggatgcaaagaggtgtgatcccacgagcacctccagaaaccagaagcacatcgtctttcgctatctgtctctgagggttcccagtctccaacttggcagctctgattgtgcatctttgctggtttgctccaatcccaacctctctgattctgatgtcagcacacgccatctccctaactatggcaactgcagcatcttctgggtgcatcccttgagcaatgtccacaccacggctgaacacatcagattctgaccactccaaccctattgtcttgcagagtccaaagatcgctccacgctgtgctctcttgagtgcgtcagaagtgccttgagaggtgaatccaagtctgccgtcaagcctagccacaccgatgaaggcaggacgacctccagccacagcagtgcagagagaggctttggcaaacttcgcacacatgagtgtgaaacccagtatctcagctggttcaaacctttctgcttgctggcttatgaagcctcccaacgctccaaatctttgctcagcctctttgatggccttctcagctgattctgctgaaaggtccttagccagaacatgacgaatggcagctgcaccagctctctgagccaactgcaatccctcaaaggtcaagacaactgcacaggctcccaacaccctcacaagagcaagtgtcaactctgagccatcgtcaacgacaagaactggacggttctccggtctttccagaatcagttcatctggccttctgatgtcaaccacctttgcgtgcatcagtgacaaatcgtcacagtcagcaccatgaactgaatcaatcttcacagctggtgcagcaccggcacttgcaggagcggctgcagccggagcaggggctgatccaccagctatctcagccttcatggcatcgaccacttctccaaccgttctggtccttgacaaagcatcgacatctttggcctcaacgttcagcatggcttgaacctcagaaaggatttccacacgcttgatgctatcaatcccaagctctgtttccaactccatgtctgactctatcatgtcagtctcgtatccagtctttgcagccaaaacctccatcacaacagtttcagctttttcaaggagttcgttgctgacagctggtgccgcggcagcgggagcaggagcggctgcagctggcgcaggagcagaacccccagctatctcagccttcatggcatcaaccacctctcccaccgtccttgttctggaaagagcatcaacatctttggcctccacattcaacatcgcttgaacctcagagaggatttcaacacgtttgatggagtcaattccaagctcggtctccagttccatgtcagattcaatcatgtcggtctcatagccagttttcgcagcaaggacttccatcacaactgtctcagccttttccaggagttctgaggagacggccggtgcggctgcagctggagccggtgccgcggctgcgggtgcaggagcggctgcagctggcgcaggcgcggaacttccagcgatctccgccttcatcgcatcaacgacctcaccaactgttctggtccttgagagggcatccacatccttagcctccacattgagcattgcttggacttcactgaggatctcaacacgcttgatgctgtcaatgcccaattccgtctcaagttccatgtcagactcaatcatgtcagtctcatagccggtttttgcagccagcacttccatgacaactgtttcagccttctcaagcaattcgttgctgacagctggtgccgcggctgcgggtgcaggtgcggcagctgccggcgcaggagcagagcctccagcaatctcagccttcatcgcatcgacaacttcccccacagttcttgtcctactgagtgcatcaacatctttagcctcaacgttgagcatggcttgcacctcagagaggatctccactctcttgatggaatctattccaagttcggtctccaattccatgtctgactcaatcatgtccgtttcgtaaccagtttttgcagcaaggacttccatcacaactgtttcggctttctccagcaactcattgctgacggcaggagcggctgcagctggagcaggtgccgcggcagcaggtgcaggtgcggctgcagctggcgcactagcagagcttccggcaatttcagccttcatggcgtccacgacctcaccgactgttctggttcttgaaagcgcatcgacatcttttgcctccacgttcaacatagcttggacctcagacaagatttcaacacgtttgatgctatctattcccaactcggtttcaagctccatgtcactttcaatcatgtcggtctcgtaaccagtcttagctgcgagcacctccatcacaaccgtctcggccttttccaggagttcggatgaaacagctggcgcgggcgcggccggtgctggtgcagctggagctggagctgcggctgccggtgcaggtgccgcggcagctggcgcaggcgcgctccctccagcaatctccgccttcatggcatccacaacctcacccactgtccttgttcttgaaagtgcatcaacatccttagcttcaacattgagcatggcttggacttcactcaggatctccactcttttgatggaatcgatcccaagctctgtctccaattccatatcagattcaatcatgtcggtctcatagccagtctttgcagccaaaacctccatcacaaccgtctcagccttctccaagagttctgaagaaacggcaggtgcaggtgcagctggagcaggtgccgcggctgcgggtgcaggagcggctgcagctggcgcgggcgcagaccctccagcaatttcagccttcatggcatccacaacctcaccaacggtcctcgttctggacagagcatcaacatccttcgcttccacgttcagcatagcttggacctcactgaggatttcaacacgtttgatgctgtctatcccaagttctgtctccaattccatgtcagactcaatcatgtcagtctcatagccggttttagctgccaagacctccatcacgacggtctcagctttttcaaggagttcgtttgagacggccggagcggctgcagctggagctggagccgcggcagcgggaccaggagcggcagcggccggcgcaggagcggagcctccagctatctcagccttcatggcattgacaacctcaccgacagttctggtccttgagagagcatccacatccttagcttccacattgagcatggcttggacttcactgaggatttccacacgcttgatggaatcaattccaagctccgtctcaagctccatgtctgattctatcatgtcagtttcgtagccagttttggcagcaaggacttccatcacaacagtttctgccttttcgagcagctcattagaaacagctggtgcagctgcagctggagccgctttagccggtgcaggtgcggcagctgccggcgccggagcggaagaaccagcgatttctgccttcatagcgttgacaacttcacccactgttctcgtcctagagagagcatcaacatctttcgcctcaacgttaagcatagcttggacttcagaaagaatttcaaccctcttgatgctgtcaattcccaactcagtctcaagctccatgtccgcctcaatcatgtctgtttcgtatccagtcttggcagcgagaacctccatcacaactgtctcagctttctcaagcaactcgttggacacggcgggagcaggagcacttgcaacgggagcggcaggggcagcggctttaacaggcgccggagcagtctgttgctgttgctgttgctgaagggaagaagcatcaacacttccataaccatccagctcagccagcatggacttgaggatggcacgatgtttctccacaacagcagtgtcaactgcaggcttggctgaagctgcagcagtcttggcttcctccttggcagcagcaagtttggagttggcttctgcagctgcacgtttggcgtcgtcaagctgcctctgagcgtcttgaagctccttctgaagcctttcagcctccctcttggcagcttcgtcaaccacaggttcaggagccttgatgagtggtgcagcacccttgaggtatgtgacacatcttccgtcgttcatggcagcatccctcactttcttggtcttgtcactgacataggtggcagctgaaagtctgagtgtggttctctttttcttgatggcttgcatcctcgtggcatcaggagcatcccacttgtcaaacccttgaagattgacaccagccacaaccagctgaactgcagcatccctcaactgtatgtcagagtccgtgccagaagctgggttcacagacactgtgacaacagacgggtcatctttgagggtttcagaaacaagtttgctgagaacttgtttcggtccaaactcaacaaagattctcgcaccagcttggtgcatgttcctcacttgggtcaggaacttcacagatgaggtcatgtgttgagtgagcatctctctggcatccgtcggataggtctctccagaaacattgctgaagagctttgtttctgctttgggtgtacggaaggaaaccttggatatgacatctttgaaagctgagctggcattttccatctgtggagaatggaaggcagactcacaagcaagaggcacaactctgaacccttccttctgcaatctggcactttcagcttgaatcccttcaacagacccagtaatgacagtctgagacggagagtttgagtttccaagccagacgttggcagcttgaaccttgatgttctctgcgttgggtcctatgacagctgccatgcaacctttgggtgtggcaggtgcatctttgcctcccatgatccttgcccttctgcaaacaagttcaaacaactcatctctgtcaacacaaccagctgcatagagcgcagcaaactcacccaagctgtgtccagctgcaaagtctggagtgaatccagcttccttgaaaatctcaaaggcaccaagagcacatgccagggttgacggctggctgtatgctgtgagtgagattttcttgtgatcttgttctggctcacgttcgtacggtttccttgggtacaggacttgagagactctttcaaagtctttgtcacttccagcaaccttggactgtgcagcgtccattgcagcaatggactgtctgaactgaggccagttcatcgcaacttcactgaacatgtgtgtgtactgagcaccttgtccagagaagagtgcagcaacagcaccattggtggcaatgcctttggcacggaaagaaactccttctctcggaagcctccacgcttctttggtcacatctttggcaaactgagcacatatagcacgaagcgtggagcacgcatcctccgcatctttgaccaagaatcccagtctcgcattggtcgcaggtatgctcccagggaacttgaactgttctccaaacttgacacacttgatgtaggcagtattcttgactgtctcattctccttgatcgcagcttcaaactctttcagctgagcttcacaaaggctctgcaacgcagcaggagttgcagccatcatcaacaccggttgtggacgtttgttgagtctgtacgctgtcgtgtgctctggttcagcctcttccaacactgcatggtagttggcacctccaaagccaaagctggatattccagcacgtctcggaacaccaggtggagggaaccagggtctgttcatcgtgttgatgtagagggatgactcattgatgggagtgttgtcatagagattgggtggattgtccacattgatcgttccaggcaaagtcttgtgtttgagagccatgatgaccttgatcattccagcaagaccagcaacagccttcaaatgaccaatactggacttgatacttccaactgcaactttctctgtgttcccttcaccatacgctttgtcaaacaagttcctcaacgcagtcaactcaatcctatctccaactggagtgccagtcccatgaccctcaaccaaagtgacagtggcagggtcaacgcaggcacgattgtatgcacgtctcaaggcttcctcttgaccactgattgtgggagtgtagatgccagctgctttgccatcacttgagcttgcacaaccacgaatcacagcatgaatctcatcaccatccctcactgcatctgcataacgtttgagcaccaacatggctgatccctcaccaatgagcatccctttcgttttctcatcatacgctctcacacttgggtccgtgctgaacacaggtgtctttgagaaagccatgtacatcccaatggagttgtctgtgcaggttgcaccagtgaccatcatgtcgcagtcaccatagagcagttcatcaatcgcaaccttgactgctatcaaggagcttgcacatgcagcatccacaacgcagttcatgccatccaagttgaatgtgttggtgcatctgccagcagtgacattcccaaggaatccagggaaagagtcaagtctccattctgggaagttcgctttgtacttctccacagccactttgacatcttcctctggcatccccatctttctcaagactttctccacaaccacatagttgagtctgctgtagaactcatgtgaactcttctgtccacctccaatgccaagcacgcatcctatgtttttcttctcctttccaagtgcatcaatcccagcatcttgaagtgcttctttgaccttgagaagtgagatggtctgattcgcatcagaatcttccatctggaacatgttgagaccaaactcacgcgcatcaaagtcatactcaggaatgaaacctcctctcttgcagtagattttgtcctttgtggtcttgactgggtcaaagtacgcagtcacatcaacacgatcctcaggaagatcagacaggcaatcaatgccagcccttatggtctcccatgactctctcaccgtggttccacaaggaagtatggcgctcatgcctatgatcgcaatcctcgtgtccatctcacctcctttctgctcttgcagcctcgctgccatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 70 - DNA, 23255 bp, Artificial sequence
  plasmid pDAB108225
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggactaggcactgagtgactcactgacctgactgagtgactggcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactactcaaagcgcattcgttggctcatagacaaaggcagcatcttcagtctcaagatcaatcctcggatcatttctcagagcattaagacgcctcaggtaacatgcaccacgcaaaatctgaaggttgatctggacaacacatgggtactcattagagacagcaggatcaagatatgttcctttgatgaagtcattgaaggctccaatggctggaccacaccagacttgatagtccatgacacgatcaggagcacccatgttggcccaacgtgatgcaagaccaagataccatctgaaacacaaagacatcttgagtttggggtcatgttccgctctctgtatcttctctggattcttcaaaccattgatgtaaaagtccttggtctcttcccagacctcttgaagtgccctcttgaagatcctcttctcgatcctttcaagttcagcaggaggcattgaatcgaaagagtcgtacttgcaaaagagttcgtacaatttgttagctcttgatgggaacattgttcccttcttgagaacttggagtttcacaccttcctcaaacatatcagctgctggagccatgcaaatgtcactgtaggtggcttgactgagttgttttctcacgttgtcacatgtcccggactgtttagcaacttgattgacagtcccagtcactatgaaggcagctcccattgtgagggcagccgcagcagcttgtgggcagccaacaccgcctccagctccaactctgactctaaggtgcgcaggataaccacactctctgtgcagtctgttcctaaggttgatgatcaaaggcaagatgacgtggatgggacggttgtcagtgtgaccaccagaatcagcttcaacagcgatgtcgtctgcgacaggaacacgacgggcaagttcggcttgttcttgtgttatctcaccagaagctatgagtttctcaaggaggtgttccggagccggtctgatgaacatttcggcgagttctgttctggacacttttccaatgatacggtttctgatgttgacactcccatcagcgttccttgagagtccggctgcacggtaacgaacaacttggggagtgagggtcatgaatgcagaagcctccaccacagtaacgcccttttcgaggaagagatcaacattccccttttccaagttgctgtcaaaaggtgaatgaatgaggttcacagcatatggtccttgaggcagagccgcttgtatcttctccaaagctgccctcacatggtgcattggaagcccacccgctccaaaagaacccaatatcttcctcttcccagcagcaatgacaaggtccgcagacgcaattcccttggccattgctccagtgtacagaggtgctgacacattgtacgtttccatgaaggacttgtcaccaagatcacttatggagcatggtttgatactgacaatccttgaagaagttgcaggtttggattcaaactgcaccaaattggagttttcaacaccaagatacaatggattgtccacttcaagcaggacatctctcaactgagtcggactgagtgcaactccagttttcccagggtccgcttttgcgctgggtggctgttgttgaacatccggaatggcttgaggttttgcactgacaacacgaactctgagttctttggcttcatacacacggagaccatcaacccaaagtgctccatctgccactatgtcaacgtagcctccattttcaggagaggctgtgattgaaactatgtgcacctcacagtccatcgcacggttctttggtgtcaattgaccacggtacttccacgccgtttttccaggggcatgggcaaaggtcggattgctcacattgtattctcccggtatgttctggtccaccgcaaatgcctcaatgagctggaacattgactcaattcccaaagatccaggcatcacaggatcaaaccaaaagtgacaagagaagaaccagtcttgtgggttaacatctttgtgtccatgcgcatatcctttcccatgcagcccagaatcaggagcaatgttgaggtaatccaaatactcacactgttctgaccttctgagaacttgagcattagttgcatctggaagtttctcagtcagctgttctttgcctttggctgatgcgatttcaactcttctcacactcgtgttgttagttttgcaccaaggctccgtctttttcccattgtcaagtccagcttgctgagcaaacacctctggagtgaaccatccaaaggaagtgcttcctttgtagaaaaccacgccatcaacagacaactcaaacgtgaatctgtgaatccccatctttcccaacattgcatatccagtgcacttggtcacattccttatggttttccccctcacatccacatctggcctcaccatttcagcacttgcatcaaggttcctaaagagaatgtcatctttgtccatcgtcagtggtgctttcaacacactggtgagaacaccggatgtctgaagtccgatttccatgatgatggaataaggcatgtgcccatcattgcaagaaccatcaaagaaccacgcatcttgaggacagtcaaactcccccaccattgtgcctttgctgggattgcaatcaacattcaggaacttgccatgttccatgtttgtgacttcaacaactctagtcacaagagccaaatcaaaagcagggcttctgctcgtatttgacttatcaaatcttgcgaactctggtcccaagcagttgctaacttttccacacatgaactctgacatgttgtaccagttcagaggcatttctccagctttgcaattgttgtcaagtgggttgccagggaaagggatgaagcaaattgccctcggagggtaagaactaggggagaagaacggcgtcgggttgccaggaagttttgacatgggatgccaggacatttctttcggagcgagagcgtcacccttgaggatatgttcaggaagtgcaactggctttggcgcaagaacatctgctgagaaagcaggcttcgcaggggcagcagaagcactagcactggcaccagagctggccttggacgcttccggtcccacagtggctgcaccgttagcaaaaacgggctgaactttggaggggttcttgttcgtggatctcttctgcatcttgagagcaatgcccttgaagtccacgacgatctttttgttaagatccccctttccgtagtcgctgattctatcaaggctgaaatcttgacccttttcgaaatcaacgtcaatgatgttgacgtcagcaatggcgtacggatcgttatcctcgtcgaatcccatctctttgatctccatgacgtagaccaactttcccttatgaggagatatctgacccctacacctaactttgttcgggtgtccgttgacgggtctgaagtcaaatggtccggtggtaaggtgcaaaccgagccagatcatgtacatcttgagcatttgtgaacaaccgtcgctgacaagagatccagccatgacttgatccttaacaaaatggcatgggaagtaccaatggtccctctccaagattttctcaccaaccaactgacccaaaccgtacacacctcccttatggtcaatgctggtgactctatcaatcatgagcatcttacgtgcgcagagtttgtagttgatctccggcatgccattctttgagccaaaaacggaagcccaatctttgtcaaccaaggtctgcatctccttttcgttgagttttgttttgtgaaggcagggagcgacagcatagggagaaacatcttgctttggaatcttagctctggcagccaaatcccctcttgtgaacaccacaccctttcccgcatcaagctcctcatttgtgaagaagccagcacagccatctctcatctcaatgagaagcctcccattgacatagcagtcatactcaaagaagaacatggagatgccaccatccaaacgtttggcaaaaccggtcactctgatgtcatactcaagggtctctccctcatgggcaaccccatagaatgtcaacgtggtgttgagcagacggtaaactctgtcaccttggttctggaaatcaattcccatgtatgatatcagcatcaaatcgcactgtccactctcaaccagaactgcccagggacaatcacctccctcagacaattcgccattcactggaagatcatactcagtgaccattctggcaccaactctgtagttgttgacctcggcatccatgagtgtgacccttgtcacaagcaggtattcacgagcaggcagcctcacccttctggggtacttgtctatgacagcaaactccggaccaaaaaccttagctatgtcaccctctgcaaactccaggagttcctcatagttgaacacctcagttttgccagaggtcagttcctccttggtcatctcccaacatggcttcttgttggtcttgacacgaagcgccatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 71 - protein, 8 aa, Artificial sequence
  ORFA Reference Protein 1
LNYVVVEK

SEQ ID NO: 72 - protein, 14 aa, Artificial sequence
  ORFA Reference Protein 2
FGALGGFISQQAER

SEQ ID NO: 73 - protein, 39 aa, Artificial sequence
  ORFA Reference Protein 3
AEIAGGSAPAPAAAAPAPAAAAPAPAAPAPAVSSELLEK

SEQ ID NO: 74 - protein, 17 aa, Artificial sequence
  ORFA Reference Protein 4
AAPAAAAPAVSNELLEK

SEQ ID NO: 75 - protein, 18 aa, Artificial sequence
  ORFA Reference Protein 5
IVQHRPVPQDKPFYITLR

SEQ ID NO: 76 - protein, 8 aa, Artificial sequence
  ORFA Reference Protein 6
IFVEFGPK

SEQ ID NO: 77 - protein, 24 aa, Artificial sequence
  apo form of pantetheinylation sites 2-9
TGYETDMIESDMELETELGIDSIK

SEQ ID NO: 78 - protein, 24 aa, Artificial sequence
  apo form of pantetheinylation site 1
TGYETDMIEADMELETELGIDSIK

SEQ ID NO: 79 - DNA, 261 bp, Artificial
  Redesigned DNA Sequence of Repeat Domain 1 of PUFA OrfA
gtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttcc

SEQ ID NO: 80 - DNA, 261 bp, Artificial
  Redesigned DNA sequence of Repeat domain 2 of PUFA OrfA
gtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctcc

SEQ ID NO: 81 - DNA, 261 bp, Artificial
  Redesigned DNA sequence of Repeat domain 3 of PUFA OrfA
gtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtct

SEQ ID NO: 82 - DNA, 261 bp, Artificial
  Redesigned DNA sequence of Repeat domain 4 of PUFA OrfA
gtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagc

SEQ ID NO: 83 - DNA, 261 bp, Artificial
  Redesigned DNA sequence of Repeat domain 5 of PUFA OrfA
gtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctct

SEQ ID NO: 84 - DNA, 261 bp, Artificial
  Redesigned DNA sequence of Repeat domain 6 of PUFA OrfA
gtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctct

SEQ ID NO: 85 - DNA, 261 bp, Artificial
  Redesigned DNA sequence of Repeat domain 7 of PUFA OrfA
gtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttcc

SEQ ID NO: 86 - DNA, 261 bp, Artificial
  Redesigned DNA sequence of Repeat domain 8 of PUFA OrfA
gtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttct

SEQ ID NO: 87 - DNA, 261 bp, Artificial
  Redesigned DNA sequence of Repeat domain 9 of PUFA OrfA
gtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatca

The invention claimed is:

1. A genetically modified *Brassicaa napus* plant that comprises a seed oil comprising 0.01% to 5% by weight of eicosapentaenoic acid (EPA), the genome of the plant comprising:
   a first polynucleotide encoding the polyunsaturated fatty acid (PUFA) synthase system polypeptide of SEQ ID NO:1, wherein the nucleotide sequence of the polynucleotide has been codon-optimized according to the codon usage of *B. napus*, and wherein the nucleotide sequence is at least 80% identical to SEQ ID NO:6;
   a second polynucleotide encoding the PUFA synthase system polypeptide of SEQ ID NO:2, wherein the nucleotide sequence of the polynucleotide has been codon-optimized according to the codon usage of *B. napus*, and wherein the nucleotide sequence is at least 80% identical to SEQ ID NO:7;
   a third polynucleotide encoding the PUFA synthase system polypeptide of SEQ ID NO:3, wherein the nucleotide sequence of the polynucleotide has been codon-optimized according to the codon usage of *B. napus*, and wherein the nucleotide sequence is at least 80% identical to SEQ ID NO:8;
   a fourth polynucleotide encoding the phosphopantetheinyl transferase (PPTase) polypeptide of SEQ ID NO:5, wherein the nucleotide sequence of the polynucleotide has been codon-optimized according to the codon usage of *B. napus*, and wherein the nucleotide sequence is at least 80% identical to SEQ ID NO: 10; and
   a fifth polynucleotide encoding the acyl-CoA synthetase (ACoAS) of SEQ ID NO:4, wherein the polynucleotide is codon-optimized according to the codon usage of *B. napus*, and wherein the nucleotide sequence is at least 80% identical to SEQ ID NO:9,
   wherein each of the first, second, third, fourth, and fifth polynucleotides is operably linked to a seed-specific promoter that is functional in *B. napus*.

2. The genetically modified *Brassica napus* plant of claim 1, wherein all of the polynucleotides are contained in a single recombinant genomic insert.

3. The genetically modified *Brassica napus* plant of claim 1, wherein each of first, second, third, fourth, and fifth polynucleotides is operably linked to *Phaseolus vulgaris* phytohemagglutinin-L (PvDlec2) promoter.

4. The genetically modified *Brassica napus* plant of claim 1, further comprising a *Brassica*-optimized polynucleotide encoding an acetyl CoA carboxylase (ACCase) or a polynucleotide encoding a type 2 diacylglycerol acyltransferase (DGAT2).

5. The genetically modified *Brassica napus* plant of claim 1, wherein the seed oil further comprises 0.01% to 15% by weight of docosahexaenoic acid (DHA) or 0.01% to 5% by weight docosapentaenoic acid (DPA).

6. A plant cell of the genetically modified *Brassica napus* plant of claim 1, wherein the plant cell comprises the first, second, third, fourth and fifth polynucleotides.

7. A plant material of the genetically modified *Brassica napus* plant of claim 1, wherein the plant cell comprises the first, second, third, fourth and fifth polynucleotides.

8. The plant material of claim 7, wherein the plant material is a *B. napus* tissue or a seed comprising the first, second, third, fourth and fifth polynucleotides.

9. A method to produce a canola oil comprising 0.01% to 5% by weight of eicosapentaenoic acid (EPA), the method comprising recovering oil from the genetically modified *Brassica napus* plant of claim 1.

10. A method for producing the genetically modified *Brassica* plant of claim 1, the method comprising transforming a *Brassica napus* plant material with the first, second, third, fourth and fifth polynucleotides.

11. The method according to claim 10, wherein the *B. napus* plant material is transformed with a single vector comprising all of the first, second, third, fourth and fifth polynucleotides.

12. The genetically-modified *Brassica napus* plant of claim 1, wherein the methionine residue at the first amino acid position of at least one of the polypeptides encoded by the polynucleotides is replaced with a chloroplast transit peptide (CTP).

13. The genetically modified *Brassica napus* plant of claim 12, wherein the CTP is selected from the group consisting of ribulose bisphosphate carboxylase small chain 1A CTP.

14. The genetically modified *Brassica napus* plant of claim 12, wherein the CTP is encoded by SEQ ID NO:11.

* * * * *